United States Patent 11,098,302 (IDENTIFICATION OF POLYNUCLEOTIDES ASSOCIATED WITH A SAMPLE) - sequence listing, part 125

SEQ ID NO: 433662 - DNA, 608 bp, Homo sapiens
  misc_feature: GZ8MTXP02IN276.4.57.F02.1.454.CMB.2.raw
  modified_base (233)..(233): a, c, t, g, unknown or other
  modified_base (389)..(389): a, c, t, g, unknown or other
  modified_base (510)..(510): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcaggtcggccccagggcaggaccggccaggactaacctgtgtcgggaaccngcagtcggaaggtaaaagtgtaacagttggtacaggcaagaacgccgaggccacggcccctggtcggtggtccgtccgttatgatacggcgacccggccctagagggtactcccgtgacgcgtattcctcgtgcctaccaacgtcgtacgggaccncggcccaccgtacgaccctatcgaacgcgtaggggaccgaacggccgggggtatacgggaacggtcccgtaattacgtaacgtgtacgtagggttggtagggaagttaggtaggtgggtanactcgactacgtagtcgtacgtacggacgtacgggaactacggtcctaccgtaccgtacgacgacgaccgaacgaccactacacgtctactaccgtcg

SEQ ID NO: 433663 - DNA, 590 bp, Homo sapiens
  misc_feature: GZ8MTXP02G0WAK.4.57.F02.1.454.CMB.2.raw
  modified_base (300)..(300): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgcgggaaccagcagtcggaaggtaaaagtgtaacattggtacaggcagaagccaggccaggcccctgtggtggtcgtcgttangatacgcgaccggccctgagggactcccgtgacgcgtattcctcgtggcctaccaactcgtagggaccaccgggcccaacccgtcgaacccatccgaggacgacggggtacggaacggccgggggatgggacggccgaagtagttaccgtgtacgagggtgtagggatagttaggtggtagatcgactccagtacgtcgtacgaacgtcgggaccaaggttccgtaccggttacctacgtaccgacgacccgaaacggccctaaacgtccctactcgtaccactttcccg

SEQ ID NO: 433664 - DNA, 615 bp, Homo sapiens
  misc_feature: GZ8MTXP02FK076.4.57.F02.1.454.CMB.2.raw
  modified_base (226)..(226): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtagggaaccngcagtcggaaggtaaaagtgtacattggtacaggcagagccaggccaggcccctgtggtgtcgtccgtatgatggccgaccggccctcgagggactcccgtgacgcgtattcctctcggtcctaccaacgtcgtaggggaaccaccgggcccacccgtcgacctataccgagcgaggggtaccgaagggcccgggggagtggacggccgaacgtacttacgtgtcgaggtggtggagtaggtaggtgggtgtactcgtactcacgttacgttcgttacgggacgtcggggaacctaacgggttccctaccggtacctacggtaccacgaccccgaacggaccccaaccccgacgttccgtacctacctccgtacctccccctaaccccc

SEQ ID NO: 433665 - DNA, 674 bp, Homo sapiens
  misc_feature: GZ8MTXP02GDX1C.4.57.F02.1.454.CMB.2.raw
  modified_base (334)..(334): a, c, t, g, unknown or other
  modified_base (364)..(364): a, c, t, g, unknown or other
  modified_base (532)..(532): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctcagtgtcaggtccggccccgagggcaggaccggaccaggaataaccgtggtaggtacgggaaaccaggactagtacgggtaaaggttaaaagtgtaactagttaggtacaggacaaggacgcgacggccacggccccgtgtggtcggtctcgttangagtcgccgaccgcctacgagggactccgngacgcgtacttcctcgtcgcctaccgaacgtcgtacgggaccgaccggtacccaccgtacgaaccctagaccgagacgaacggggtacggaaacgggcggggatagggaacgcccgtaacgttacgtttaccgagtcgtagggtcgtagggtaataagggtgggtagngtaactcgtaactacgtattccggtacgttacggtaacgtaacgggtaaccgtaaccgggttccctaccggttaccgtaccgacaacccgtacccgaaacggtacccaacgttaccacgttacgtacctaccggtttccccg

SEQ ID NO: 433666 - DNA, 655 bp, Homo sapiens
  misc_feature: GZ8MTXP02G3VBK.4.57.F02.1.454.CMB.2.raw
  modified_base (214)..(214): a, c, t, g, unknown or other
  modified_base (219)..(219): a, c, t, g, unknown or other
  modified_base (267)..(267): a, c, t, g, unknown or other
  modified_base (284)..(284): a, c, t, g, unknown or other
  modified_base (312)..(312): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccaggcagacgcaggatactgtgnggacngcatcggagtaaagtgtacagtggacaggcagagcaggccacggcccngtggtggtcgtcgttangatagcgaccgcctcgagggactcccgngacgcgtattccctcgtacggctacccgaactccgtacgggaccgaccgggcccaaccccgtacgaaccactaccgacggaccgaacgggggtacccggaaaggggcccgggggaatcggggacgggtacccggtaaacttaagttaccgtaggtaccgtaaaggggtggtaggggtagttagggttaggtgggtacgtagtcgtaactaccgtaacgttacggttaccgttacgggaaacgttacggggaacccgtaagggttcccttacccggtacccgtaaccgtcccgaaccggaccccaaaggccccaaaccgtccaaccgttcgcctacttccccgg

SEQ ID NO: 433667 - DNA, 677 bp, Homo sapiens
  misc_feature: GZ8MTXP02GGBCE.4.57.F02.1.454.CMB.2.raw
  modified_base (226)..(226): a, c, t, g, unknown or other
  modified_base (257)..(257): a, c, t, g, unknown or other
  modified_base (297)..(297): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgccaccctcagtgtcagtcggccccagggcagacggcaggataactgtgtggaaccngcagcggaaggtaaagtgacattggacaggnagaagccgaggccacggcccctggtggtcggtcgtcgtangatggcgaccggcctcgagggtactcccgtgacgacgtacttcctcgtcgcctaccaacgttcgtacgggaaccgccgggacccctaacccgtacgaacccgtactccgaacggaccgaaggggtacgaaacggggcccgggggaatcggggaacgggcccgtaaagtttaacgtaccgtaggtcggtaaggggtggtaggggtaagttagggtaagggttcgggtaggtaactcgtaacgtccgtaagttaccggtacggttacgggaaaacgtcggggtaaaccgtaaacgggttcccgtaccgttaccgttacggaccacccggaacccgaaaacggtccccaaacgtccctaactcggtaaccctacggtttcccg

SEQ ID NO: 433668 - DNA, 722 bp, Homo sapiens
  misc_feature: GZ8MTXP02FL496.4.57.F02.1.454.CMB.2.raw
tcagagcactgtagcacgaccggtgctcgattagctcgatatagttgggtttggggggaagaggaagactgacggtcctcccaggagttcaggtgctgggcaccgtgggcagtggggggaggcgtggtccagcctggggggtccctgagactctcctgtgcagcgtctggattcgccttcagtgcctatggcatgcacgtgggtccgccaggcctccgaggcgaaggggctggaagtggggtgctagttatagtggtttgagtaggaaactaaactaaaatttctaatcgacaagtacctccggtaggaacgggtcctattccaacctatcctaccgaagaacgtaactaaacgtttacggaaagaaactacgtattagaaacttactaacaagtatacgaaactgtactaggaagacgaccggaggaccacgggtcttgtactttaagttagttgtagacggtaaggtaagttaaggtggttactagttcggtttaccgtttagaccgtagggtcggggaccgtaacggggtaccctggtaccctacccgttctccctacgtaccgtccgttacccgaaaccggtaaccgggccctaacggttccccggttacccctttcccccggcggtcccccgtcccgtcgtcccgttaccggaacgggacccgaaccgtacccggttcgggacccgggggaccaaccgggccggcccgggtccccgg

SEQ ID NO: 433669 - DNA, 657 bp, Homo sapiens
  misc_feature: GZ8MTXP02I8IIO.4.57.F02.1.454.CMB.2.raw
  modified_base (210)..(210): a, c, t, g, unknown or other
  modified_base (363)..(363): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcacgtgggtccncaggcctccaggcaaggggctaggaagtggggtgactagttatagtggtttgagtggaaactaactaaattctatgcagacctccggtagaacgggccattccaccatcctccaagacgactaatttcgaagaactacattgaaatcctaaanagactagaactgtacgtgaagacgccggagaccacggctagttactattagtgtagcgtaagtagtaagtgtactacgttcggttcgtttagaccgtaggtcggggtaccgacgggtaacccgtggtaccgtaccggttacctcccgtacgtacggtccttacccgaaccggaacgggtacccctaggttcccggttccccttccccggtcgggtcccgtcccgttcggaccccttccggaacgaaccgtaccgtccgtacgggtacgggggaccctacggaccgggtccccgg

SEQ ID NO: 433670 - DNA, 572 bp, Homo sapiens
  misc_feature: GZ8MTXP02I2BP8.4.57.F02.1.454.CMB.2.raw
  modified_base (223)..(223): a, c, t, g, unknown or other
  modified_base (251)..(251): a, c, t, g, unknown or other
  modified_base (291)..(291): a, c, t, g, unknown or other
  modified_base (330)..(330): a, c, t, g, unknown or other
  modified_base (352)..(352): a, c, t, g, unknown or other
  modified_base (410)..(410): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccngcatcggagtaaagtgtacattggtacnggcagagccaggccaggcccctgtggtggtcgtccgttangatagcgaccggcctgagggactccctgagcgtatctcnggcctccaactctagggaaccncggccacctgaccatcagcgagggtcgaagccggggatggacggccgtactattacgngtcaggtggtagggattaggtaggtggtgatcgatcctagtacgtcgttcggaaactggggaaccctaaggtccacgttcgtacccgttacgcgaacggtccccaaacgggtccccaaaacccccgtcgtcggtaccctaccgttccgttcgtttacccccc

SEQ ID NO: 433671 - DNA, 663 bp, Homo sapiens
  misc_feature: GZ8MTXP02ING19.4.57.F02.1.454.CMB.2.raw
  modified_base (239)..(239): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcgaggtcggccccgagggcaggaccggccaggactaaccgtgtggtacgggaaccngcagtacggaaggtaaaagtgtaactagttggacgaggcaaggaacgccgacggccacggccccgtggtcggtggttcgtcgttagcgaagtacggccggacccggccctaggacgggtactcccgaggacgtcgtatttccctcgtcggccttaccaacgttccggaacgggtaccgcccggaccctaacccgtacgacctagcgacgcggtagggaccggaagggccgggatacgggacggtacccgtaattacgttacgcgtcgtagggttcggtagggtaagtagggtagttcgggatacgtcgtaactcctaagttaccgttcggtaacgtaaccggtacgggtaaccgtaacggtccttccgtaacgttaccgacgccgaaccgaacgtaccacctcaacgttctacctatttccccg

SEQ ID NO: 433672 - DNA, 539 bp, Homo sapiens
  misc_feature: GZ8MTXP02FJKJU.4.57.F02.1.454.CMB.2.raw
  modified_base (410)..(410): a, c, t, g, unknown or other
  modified_base (412)..(412): a, c, t, g, unknown or other
  modified_base (417)..(417): a, c, t, g, unknown or other
  modified_base (429)..(429): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcgggggagcgtggtccagcctgggggtccctgagactctcctgtgcagcgtctggattcgccttcagtgcctatggcatgcacgtgggtccgcaggctccgaggcgaaggggctagggaagtggggtgctaaggtttatagttggtttagataggaaactaaacaaattcatgacagactcgtgaacggcgtatcacancncaganactaattcgaanaactacatagaatactacagatacgaactagtcgtagagagaccgaaggaccgacggctgtactattacgtgagtacgaagtagtagtaggtctagtcggtccgtttacg

SEQ ID NO: 433673 - DNA, 756 bp, Homo sapiens
  misc_feature: GZ8MTXP02I7G8Y.4.57.F02.1.454.CMB.2.raw
  modified_base (300)..(300): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtggaaccagcagtcggaaggtaaaagtgtacagttggtacaggcagacgccaggccacggccctggtggtggtctcgttangatagcgaccggcctcgagggactcccgtgacgcgtacttcccgtcgtcggcctaccaacgtcggtacgggaccgaccgggccccacccgtacgaccctagtaccgacggaccggaacgggggtacgaaacggggtccgggggaatcggggaacggtcccgtaacgttacgttaacgtcggtacgaaggggttggtaggggtaagttagggtaagggttggggtactaacgttccgtaacgttaccccgtaaacgttcccggttaccggttaaccggggtaaaacccggttacgggggaaaaccccgttaaaacggggttcccccgttaaccccgggttaaccccgtttaaaccggtacccggtaacccggaacccccggaaaaccggggttacccccaaaaacccgtttccccgaaaaccgtttccggtaacccctttaacccggttttcccccg

SEQ ID NO: 433674 - DNA, 709 bp, Homo sapiens
  misc_feature: GZ8MTXP02JSA1X.4.57.F02.1.454.CMB.2.raw
  modified_base (363)..(363): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcgagggactccctgacgcgtattcgtcgtcggctaccaactcgtacgggaaccncgggtcccacccgtcggaccagtccgacggcgacgggggtacgaaacgggcccgggggatacgggacgggcccgtaacgttacgttacgtcggttacgagggtgggtagggggattagggtaggtaggggtaggtacgttaccagttaccccgtaagtttaccgggtccgtttaaccgggaaacggtacgggggtaacccgtaaaacggggttccccgttacccgggttacccgttaccggggttacaacccgggaacccccgaacccggggaccccctaaacccccggtacgttccggtccgtaaacccttcccggtaacccgtttccccccttaaacccccccg

SEQ ID NO: 433675 - DNA, 665 bp, Homo sapiens
  misc_feature: GZ8MTXP02GVVOD.4.57.F02.1.454.CMB.2.raw
  modified_base (223)..(223): a, c, t, g, unknown or other
  modified_base (231)..(231): a, c, t, g, unknown or other
  modified_base (262)..(262): a, c, t, g, unknown or other
  modified_base (305)..(305): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctcagtgtcaggtcggccccagggcaggacggccaggactaacctgtgngggaaccngcagtcggaaggtaaagtgtacagttggtanaggcagaagccgaggccacggcccctgtggtggtcgtcgttangatagcgaccggccctgagggactcccgtgacgcgtattccctcgtcggcctacctaacgtcggtacgggaccgaccgggacccaccccgtcgaaccctagtccaaggtccgagggggtacgaacgggccgggggatcggggacggacccgattaacgttacgtcggtacgtaaggggtggtaggggtagttaggttagggtgggtagactacgtacgtcctaagttaccggttacgttaacgggaacgttacggggaaccgtaaacgggttcccgttacccggtacccgttaccgtaccgaaccgaccccggaacggaccccctaactcccgtaacgttccggtacctaccgtttcccg

SEQ ID NO: 433676 - DNA, 747 bp, Homo sapiens
  misc_feature: GZ8MTXP02JKSB8.4.57.F02.1.454.CMB.2.raw
  modified_base (227)..(227): a, c, t, g, unknown or other
  modified_base (314)..(314): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacgtgtgtggaacngcagtcggaaggtaaagtgtacagttggtacaggcaagagcaggccacggccctgtggtggtcgtcgttatgataggcgaccggccncgaggtactcccgtagacgcgtacttccctcgtcggcctaccgaactcggtacgggaccaccggacccacccgtacgaacctagtaccgaacggaccggtaacggggtacccggtaaacggggcccgggggtaattaacccggggaacggggtacccggtaactttaaacgtttaaccggtcgggttaccgtaagggggttcgggttaggggtaaagtttaacggggttaagggttggggttaactacggtctaaaccgttaccgtaaacgttaccgggtttaccgttaaccgggaaacggttaccggggtaaaaccgtaaaccggggttccttaccccggtaccggttaacccgttccggaacccgaccccgtaaaacggtcccctaaaacccgtccgtaaccgttaccggtacccttaacgtttacccccg

SEQ ID NO: 433677 - DNA, 688 bp, Homo sapiens
  misc_feature: GZ8MTXP02G4XV8.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatggggggaggcgtggtccagcctgggggggtccctgagactctcctgtgcagcgtctggattcgccttcagtgcctatggcatgcactggggtccgccaggcctccgagggcgaagggggctgggaagtggggtggctagttatagttgggtttgataggaaactaaactaaattctatgcagactccggtagaacggccgattcaccatctccagagactaattcgaagaacatattagaaatctaacagtatacgaaacagtactaggagacgacggagggacacggcttgttacttattagttgtagacgaaggtaagtaggtcggtagtagttcggtttactttacggaccgtaggggtcggggaccgtaacggggtaacccgtcggtacccgtacccgttcgttaccctacgtaccgtccgttacccgaaccggtaaccgggtcccctacggttccccggttccccgttcccccggtcggtcccccggtcccgtacggtcccgtacccgacgggtaccgaacccgtaccgtccgggtacgggggcccaaccggccgggtcccggtcccggg

SEQ ID NO: 433678 - DNA, 693 bp, Homo sapiens
  misc_feature: GZ8MTXP02IYE2X.4.57.F02.1.454.CMB.2.raw
  modified_base (221)..(221): a, c, t, g, unknown or other
  modified_base (304)..(304): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcagtcggcccgaggcagacgccaggactaactgtgtcggaacngcagtacggaaggtaaagtgtactagttggtaacaggcagaacgccgaggccacggccccgtggtcggtcggtccgtacgttntgatacgccgacccggcctggacggtctcccgtgacgcgtactctcgtcgacctcaacgtcgtacggaacccaccggcccaccgtacgaccagtcacggcgacgggtaccgagggccggggtagcgggaccggccgtaattacgttacgtggtacgagggttcggtagggtagttagggttaggttcggatacgtactacgtaccgttaaggttaccgttcggttaaggaaacccggttacggggtaaacccgtaaaccggttccgttaccccgtttaaccggttaaccgaaccgtaacccggaaccccgtaaccggaaaccccctaacccccgttacgtaccggtacccttacccttcccgttccccggtttacccccccgttccccg

SEQ ID NO: 433679 - DNA, 709 bp, Homo sapiens
  misc_feature: GZ8MTXP02IZHYU.4.57.F02.1.454.CMB.2.raw
  modified_base (212)..(212): a, c, t, g, unknown or other
  modified_base (218)..(218): a, c, t, g, unknown or other
  modified_base (250)..(250): a, c, t, g, unknown or other
  modified_base (294)..(294): a, c, t, g, unknown or other
tcagagcactgtagcacgaccggtgctcgatttagctcgatatagttggtttggggctgggcctaaggaagcagcactggtggtgcctcagccatggcctggaccgttctcctcctcggcctcctctctcactgcacaggctctgtgacctcatatgtgctgactcacgccacctcagtgtcagtcggcccaggcagcgcagactactgtgnggaacngcagtcggaagtaaagtgtacagttggtaacnggacagaagccgaggccacggccctaggtggtggtcgtcgttangactacggcgaccgcctacgacgggtactcccgtagacgtcgtatttcccgtcgtcggtcctaccgaacgtccgtaacgggaccgtccggacccctaacccgtacgaacccctattaccgacggtaccgtaaggggtaaccggaaaccggggccgggggaatacgggaacgggtaccccgtaattacggtttaacgcggttacggtaaagggtttcgggtaagggtaaacgttgggttacgggtaggtacgtaaacgtctaacgttaccgtaaagttccggttaccggttaacgggacgttaccgggggaaccttaacgggttcccgttaccggtacccgttacgggaaccccacgggtaacccaaaacggtcccctaaccgtacccgtacttccggtacctacccgttttcccg

SEQ ID NO: 433680 - DNA, 737 bp, Homo sapiens
  misc_feature: GZ8MTXP02HHJOK.4.57.F02.1.454.CMB.2.raw
  modified_base (294)..(294): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacagttggtaacaggcagaagccaggccaggcccctgtggtgtcgtcgtangatagcgaccgcctcagggatcccgtgacgcgattctcgtcggcctacccaactcgtacgggaaccaccgggcccaacccgtgaacccatcgacgcgaaggggtcgaaacgcccgggggatcgggacggacccgtaacttaacgttaaccgtggttaccgaggggttacgggtagggggtaaagttaggggttaaagggtttcggggtagggtaactttaccaacggtttaccctaaacgttacccggtttacgtttacccgggggtaaaccgttacgggggaaaaccccgttaaaacgggtccccgttaccccggttaacccgttaaccggttacccgtaaaccggacccccggtaaaaccgggacccccaaaaccccccggtaccttaacgggtcccctaacccttaccccggttcccgttttacccccccggtccccccc

SEQ ID NO: 433681 - DNA, 644 bp, Homo sapiens
  misc_feature: GZ8MTXP02H4DUL.4.57.F02.1.454.CMB.2.raw
  modified_base (206)..(206): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagccgtgggggtccctgagactctcctgtgcagcgtctggattcgccttcagtgcctatggcatgcacgtgggtccnccaggctccgaggcgaaggggctggaatgggtgctagttatagtggtttgagtaggaaactaaacaaattctatgacaagacctccggtagaaacgggcctaattacgaccctatcctaccgaaggaacgaactaaagtttcgaaagaaacactaatttagaaatactaacaagatacgaaacagttacagagacgccggagaccgacggcttagtaccttaagttaattggtacgagaggtaagttaaggtggtactagttcggttccttttacggaccgtagggtcgggacgtaacgggtacccgtggttacccaccgttctacccgtacgacgtccttaccgaacgaaccgggtcctacgtcccggttcctccccgtggccctcctcgccacgacgaccgtccgaccgtcggcgggacaccggacggtccgccgg

SEQ ID NO: 433682 - DNA, 788 bp, Homo sapiens
  misc_feature: GZ8MTXP02IQZUU.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtggaggtcggggggaggcgtggtccagccgtggggggtccctgagactctcctgtgcagcgtctggattcgccttcagtgcctatggcatgcacgtgggtccgcgaggctccgaggcgaaggggctagggaagtggggtggctagttatagttggttagagtaggtaaactaaactaaattctaatgacaggtacctaccggtaggaaacggggcctaattcccaacctatcctaccaaggtaacgaacctaatttacggaaactaaacctacgtaattacgaaacttcgtaaacaagtaactaacgaacgtacgtacgtaggaacgacgggaccggaagggaacctacggggtcttaggttactttagtttagttggtagtacggtaaggtaaaggttaaggttgggttactaacgtttcgggtttaccgttttacgggaacgtacggggttaccgggggtaaccggtaaccgggggtaaacccgttcgggttacccgtacccggttcccgtacccgtacgacggtaccccttaacccgaacccggtaaaccggggtcccctacggtttccggttcccccgtttccccggtccggtaccccgtcccgtcgtcccgtacccggaacggccggtaccgtacccggtcgggtaaccgggggccaccggaccgggtcccggg

SEQ ID NO: 433683 - DNA, 744 bp, Homo sapiens
  misc_feature: GZ8MTXP02HI92H.4.57.F02.1.454.CMB.2.raw
  modified_base (267)..(267): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccgaggcaaggggctggaatggggtgctagttatagtggtttgatggaactaaanaaattctatgcagactccgtagaacggccatcaccatctcagagactaatttcgaagaacactattagaactactaacagatacgaaacagtcgtagaagacggccgaggaccaacggtcttagttaccttaagtttacgttgtacggtacggtaaggtaaagttaaaggtggtacgtacgtttacggggtttcccttttaggaacccgtacggggtcggggtacccgtaaccgggggtaaaccccgttcggggttacccgtaacccgggttcccttacccgttccgtaacggttcccttaccccggaaccggaaaccggggtcccccttaacgttcccccgggtttccccgtttccccccggtcggggtacccccgtccccgtaccggtccctacccggtaaccggggaccgtcccggtacccgttaccgggtcggggggacccctaccggtacccggggcccgggtcccccgggg

SEQ ID NO: 433684 - DNA, 692 bp, Homo sapiens
  misc_feature: GZ8MTXP02H0D44.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacgcaggataactgtgtggaaccagcagtacggaaggtaaaagtgtacagttggtacaggacagaaagccaggccaggcccctggtggtggtcgtccgtatgatagccgaccggccctgagggactcccgtgacggcgtacttcccgtctacggcctacccaacttccgtacggggaccgacccgggtaccaccccctagaacccactacgacgaccgaacggggtaccggaaacgggcccgggggaagtggaaccgggaccggaacttaacgtaaccgtgtaccgaaggggttgaggggtaagttagggtaagttggggttagactacaacgttaccaagttaccgttcgtaccggggtaaacgttcggggaaacccgtaaacgggttcccgttcccggttaaccccgttaccggtacgaaccccggaccccgtaaaacggggccccctaaaacccggtcccgtaaccttcgtaaccctcctttacccccg

SEQ ID NO: 433685 - DNA, 550 bp, Homo sapiens
  misc_feature: GZ8MTXP02I6ET2.4.57.F02.1.454.CMB.2.raw
tcagagcactgtagcacgaccggtgctcgatttagctcgatatagttgggtttgggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatgggtgcagttatatggttgatggaactaacaaattctatgcagactccgtgaaggccgattcaccatctccagagacaatttcgagaacacattgaatctacagatacgaacagtctagagacgccgaggacacggctgtcttattagttgtgcgagagtaagtggtcagttggtctttgaccgaggtcgggaccacgggaacctggtcaccgttctcctcgcgtcctcaccgtaacggcctagtccggtcctccccgtggcccgtccctcgcctaccgacggacgccgtaccgtcgtcggggccacgacggccggtcccg

SEQ ID NO: 433686 - DNA, 690 bp, Homo sapiens
  misc_feature: GZ8MTXP02HNKI8.4.57.F02.1.454.CMB.2.raw
  modified_base (315)..(315): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataaccgtgtgtgggaaccagcagtcggaaggtaaaagtgtacagttggtacaggcaagaaacgccgaaggccgacggccccttggtgggtcggtccgtccgttanggagtagccggaacccggccctgacggggactcccgtggacgcgtatcccgtcgtcggcctacctacgtccgtacggggaaccgccgggtacccaaccccgtcgtaaccacgacgtacggacgggtaacggggaccggaccggggacgggggacgttacggggacggtacccgtaacgttacgttacgtaggtcggtaaggggttggtaggggtaagtttaggggtaggtgggtagtactacggtactaccgtacgttaccgttacgggtaacgtacggtacgggaaacgtacggttacgttcccgtaccgttaaccgcgtaacccggaccgaaccggacctaaacccgtcgacctcgtaccttaccctttcccg

SEQ ID NO: 433687 - DNA, 752 bp, Homo sapiens
  misc_feature: GZ8MTXP02IFNCK.4.57.F02.1.454.CMB.2.raw
  modified_base (228)..(228): a, c, t, g, unknown or other
  modified_base (303)..(303): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcagtcggaaggtaaaagtgtaacagttggtacaggcaagaagccgaggccaggcccctgtggtgtcgtcgttangatagcgaccggcctgagggctcccgtggacgcgtacttcccgtacgtcggcctcctaaacgtccggtacggggaaccgacccgggacccctaacccccgttacgaaccccctaacgtaccgaaacgggcccgggtaaacgggggtaccggaaaacggggccccggggggtaaagtcggggaaccggggaccccggttaaacgttaacgtttaaccgtcgggtacgtagggggttaggttagggggaatttaggggttacgggttaggggtagtacgttacgtaacgttacccgtaacgtttaaccggttacggtttaccggggaaaaccgttacgggggtaaacccgtaacggggttcccttacccgggttacccgttaccgtaccgtaaccgaccccgaaacgggtcccctaaaacgtcccaaccgttccgtacctaacctttcccg

SEQ ID NO: 433688 - DNA, 565 bp, Homo sapiens
  misc_feature: GZ8MTXP02HE59M.4.57.F02.1.454.CMB.2.raw
  modified_base (241)..(241): a, c, t, g, unknown or other
  modified_base (257)..(257): a, c, t, g, unknown or other
  modified_base (275)..(275): a, c, t, g, unknown or other
  modified_base (286)..(286): a, c, t, g, unknown or other
  modified_base (289)..(289): a, c, t, g, unknown or other
  modified_base (457)..(457): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtgccccaggcagacgcaggataactgtgtggaaccagcatcggaaggtaaagtgtanatggtacaggcagaancaggcaggcccctgtggngtcgtcgttanganagcgaccgcctgacggactccgtagacgcgtacttcctcgtcgcctaccaacgtcgacgggaccgaccgtacccaaccctacgaaccatacagacgacggacggaacggacgggagagacgacgaactaatacgtagtacgtaggtggtaggtagtagtagtgtaganactactactactacgtacgtacgtaacgtacggaacgaacgtaccgtaccgtaccgtacgtacgaccgaaccgaaacgaaccgaaacctacctactacgtactactcg

SEQ ID NO: 433689 - DNA, 916 bp, Homo sapiens
  misc_feature: GZ8MTXP02FO3QC.4.57.F02.1.454.CMB.2.raw
  modified_base (208)..(208): a, c, t, g, unknown or other
tcagagcactgtagcacgaccggtgctcgattagctcgatatagttggggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccnccaggcctccgaggacgaagggggctagggaagtgggggtgactaagtttatagttgggtttagaagtacggaaactaaacaaatttctaatcgacaaggtaccgtaccggtaggaaacggggtccctaactttccaaacccctagtttaccccttaccgaaaaggtaaacttaaaaccttaaaagttttacccgggaaaacgtaaaacctaaacttaaagtttaaacgtaaaaccttaaccgtaaacgtaaaggtaactaaaccggtaaaaccgttacggtacggtaagggaaacggaaaccggtacccggggaacggggtaacccgtaaccggggtttaccgtttagtttaacgtttttaagtttacgggtttaggtacggtaaacggtaaaggttaaaggttaaagggttaccggttacgtttaacggtttaccggttttacccgtttaacgggaaaccgggtaacggggtacccgggggtaaacccggtaaaccgggtaaacccgttcggtaaccccgttacccgttaccgtacccgtaccgtaccgttaccccgtaaccccggaaaccgggtaacccggtacccgtaccggttcccccggttccccgttcccccggcggtccccgtacccgtccgtaccgtaccggaacgaccgtaacccgtacggtccgggacggggaccacgggacccggtccggtcccgg

SEQ ID NO: 433690 - DNA, 677 bp, Homo sapiens
  misc_feature: GZ8MTXP02GQPRC.4.57.F02.1.454.CMB.2.raw
  modified_base (226)..(226): a, c, t, g, unknown or other
  modified_base (365)..(365): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggacggccaggactaaccgtgtgtggaaccngcagtcggaaggtaaagtgtacagttggacaggcagaagccaggccgaggcccctggtggtggtcgtccgtatgataggcgaccggcctcgagggactcccgtgagcgtattctcgtggcctccactcgtagggaaccncggcccacctgaccatcgagcgagggacgaggccgggatcggacggccgtatacgttacgtggtacgaggtggtagggtattaggttaggttggtggtactacgtaacgttccgtaaacgttaccggttaccggttaacgggtaacgttacgggggaaacccctaaacggggtttccccgtacccgggttacccgttaaccggtaccgaacccggtaacccccggaaacccgtacccccgaaaacccccgtacgtttacccggtacccgtaaccttacccggtttccccgtttaacccccctttaacccccg

SEQ ID NO: 433691 - DNA, 568 bp, Homo sapiens
  misc_feature: GZ8MTXP02HE5MV.4.57.F02.1.454.CMB.2.raw
  modified_base (299)..(299): a, c, t, g, unknown or other
  modified_base (304)..(304): a, c, t, g, unknown or other
  modified_base (313)..(313): a, c, t, g, unknown or other
  modified_base (318)..(318): a, c, t, g, unknown or other
  modified_base (331)..(331): a, c, t, g, unknown or other
  modified_base (343)..(343): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctgggaatgggtgcagttatatggttgatggaactaacaaattctatgcagactccgtagaaggccatcacatcncaganacattcganaacanattagaatctaanagtatacgaacngtcagagacgccgaggacacggctgtactattatgtgacgagtagtagtgtctagtcgttctttagacctagggtcggggaccgaacgggtaacccgtggtaccaccgttctacctcacgtccttaccgacgacggccctagtcccgtaccttccccgtcggccgtccctcgccgtaccgacggaacgccgtaccgtcggtcggggaccacggacgccggtccgg

SEQ ID NO: 433692 - DNA, 777 bp, Homo sapiens
  misc_feature: GZ8MTXP02JQCZT.4.57.F02.1.454.CMB.2.raw
  modified_base (178)..(178): a, c, t, g, unknown or other
  modified_base (327)..(327): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctnagtgtcaggtcggccccgagggcacggacggccaaggaactaaccgtggtggtacgggaaccagcagtacgggaaggtaaagtgtactagttggtacaggcaagaacgccgaggccgacggccccgtggtggtcggtccgtccgttagngagtacggccgacccggtccacggacgggtactcccgtagacggtcgtacttcccgtcgtccggtcctacccgtaacgtcggtacggggaacccgaccgggacccctaccccgtacgaacccgtaactccggaacgggtaccgggtaacgggggtaacccggaaacgggggcccgggggtaattacgggggaaccgggggtacccctaaacgtttaacggtttaccgtacgggttaccggtaagggggttgggttaaggggtaaacgttaaggggttgggtaggggttacgacgttactaaccgttaccggtaacggttacccggtttaccggttaacgggtaaccggttacggggaaaccgttacggttacccgtacccggttaccgtaacgtacccgaaccggtacccgaacgacccgtaacctccgtactcgtacccacgtttcccg

SEQ ID NO: 433693 - DNA, 632 bp, Homo sapiens
  misc_feature: GZ8MTXP02FZ50W.4.57.F02.1.454.CMB.2.raw
  modified_base (217)..(217): a, c, t, g, unknown or other
  modified_base (290)..(290): a, c, t, g, unknown or other
  modified_base (318)..(318): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacgcaggatactgtgtaggaacngcagtcggaagtaaagtgtacagttggtacaggcaagaagccgaggccacggccctggtggtggtctcgttangatgcgaccggcctacgaggactcccgngagcgattcgtcgtcgcctacccgaactcgtacgggaaaccaccgggcccaccctagaacccactcaaggccgagggggtacgaaacggcccgggggagtacggacgggacccgtaactagttacgtggttacgagggtcggtaggggtataggtagggtgtaggatacgactaccgattaccgtacgttacggaaacgtcgggaacctaacgggtccctaccggtacccgtaccgtaccgaccgacccgtaaccggaaccccaaaccccgtcgtaccgtccctaaccttccgttacccgtaccccctaccccg

SEQ ID NO: 433694 - DNA, 510 bp, Homo sapiens
  misc_feature: GZ8MTXP02GKF0W.4.57.F02.1.454.CMB.2.raw
  modified_base (412)..(412): a, c, t, g, unknown or other
  modified_base (416)..(416): a, c, t, g, unknown or other
  modified_base (425)..(425): a, c, t, g, unknown or other
  modified_base (469)..(469): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccaggacagacggccaggataacctgtgtggaaccagcatcggaaggtaaaagtgtacattggtacaggcagaagccaggccaggcccctgtggtggtcgtccgtatgatagcgaccggcctcgagggactccctgagcgattccctcgtggctaccaactcgtagggacctcggcccaccctcgaccatcagcagggtcgaaggccgggatgaggccatntacngcagggtgngggaatgagtggtgatcgatcatcgtctcggatggaccagtccncgtcacgtcacgccaacgccaactccgactcgccacttccg

SEQ ID NO: 433695 - DNA, 707 bp, Homo sapiens
  misc_feature: GZ8MTXP02HGXAI.4.57.F02.1.454.CMB.2.raw
  modified_base (674)..(674): a, c, t, g, unknown or other
tcagagcactgtagcacgaccggtgctcgatttagctcgatatagttgggtttggggggaagaggaagactgacggtcctcccaggtgtccagtgtcaggtgcacctggtggaggtcggggggaggcgtggtccagccgtggggggtccctgagactctcctgtgcagcgtctggattcgccttcagtgcctatggcatgcacgtgggtccgccaggctccgaggcgaaggggctaggaagtggggtggctagttatagttggtttagagtaggaaactaaactaaattctatcgacagacctccggtaggaacggggcctattaccgaccattccgtaccaaggaacgtaaacctaaacgttttacggaaaacgtaaaacctaactaagttacgaaacttactaaacgaagtaataacggaaaactagtacgtaggaaggacgacccggaaggaacgacggtccgttagttactaagtttagtgtagagtaagaaggttaggtgtacgtagtcggtttaccgtttagacgtagggtacgggaccgaacgggtaacccgttcggaccgtaccgtctccgtacgtacgtccgttaacccgaaccgaaaccgggtccctaacggttcccggtccccttccccgtcggcccgtccgtcgccctacggaacgcgaccncccggttcggccggggacaccggacggccccgg

SEQ ID NO: 433696 - DNA, 588 bp, Homo sapiens
  misc_feature: GZ8MTXP02FOLY8.4.57.F02.1.454.CMB.2.raw
  modified_base (539)..(539): a, c, t, g, unknown or other
  modified_base (554)..(554): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggaggtcgggggaggcgtggtccaggccgtggggggtccctgagactctcctgtgcagcgtctggattcgccttcagtgcctatggcatgcacgtgggtccgccgaggcctcccgaggcgaaggggctagggaagtggggtggctagtttatagttgggtttgataggtaaactaaactaaagtttcaatggacagtactccggtaggaaacgggcccgtatttaccacctatccctacccgaagacgaactaaagtttaccgaagaaaccaactaatagaaattactaacaagatacgaaacagtctagaagacgaccgaggaccgacggtntacgtatattcgtgngagaagtagtacgtgtactacgtcgttacttacg

SEQ ID NO: 433697 - DNA, 790 bp, Homo sapiens
  misc_feature: GZ8MTXP02GUQTV.4.57.F02.1.454.CMB.2.raw
  modified_base (208)..(208): a, c, t, g, unknown or other
  modified_base (242)..(242): a, c, t, g, unknown or other
  modified_base (260)..(260): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggagcgtggtccagcctgggggtccctgagactctcctgtgcagcgtctggattcgccttcagtgcctatggcatgcacgtgggtccncgaggcctccgaggcgaaggggctaggaatgggngctagttatagtggttanagtaggaaactaacgtaaattctaagtcgacaagaccttcggaggaaacgggtcctaattaccccaacgtagtccgtaccgaaggtaacgtaaccgttaagtttaccggaaagtaaaaccctaataacgtttagaaactttaccaaagtaagtacttaacggaaacctagttaccgtaggaaacgacgggaccgggaacggacgtacgggtacctttaggtaactttaagtttagttagcgaacggtaagtaaggttaaacggtgtataacggtttcgggttacctttaggaacccgtaggggttacggggacccgttaaacggggtacccgttgggtaccctaccggttacctccccgtagaaccgttccgttaacccgaaaccggttaacgggtcccctacgggtttcccgggtacccctttaccccgggcgggtaccccttacccggtcgtaccccgttacggaccggtaaccgtcccgtaaccggggttcggaccgggggtaacccctaccgggtaccggtcccgg

SEQ ID NO: 433698 - DNA, 629 bp, Homo sapiens
  misc_feature: GZ8MTXP02J2LNN.4.57.F02.1.454.CMB.2.raw
  modified_base (177)..(177): a, c, t, g, unknown or other
  modified_base (229)..(229): a, c, t, g, unknown or other
tcagagcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagcccaccctcagtntcagtcggccccagggcaggaccggccaggactaaccgtgtgtagggaaccngccagtcggaaaggttaaaagtgtacagttggtacaggcagaacgccaggccacggcccctgtggtgtcgtccgtatgatcgacgaccggccctcgacgggactcccgtggacgcgtacttcgtctcggcctacgactcgtaggaaccacgggcccacctcgaccatcgacgtcgacgggacgaacgggccggaagtcggaaccgggccgtaacgttacttaccgtagtaccggtagggtacggtaggggaattaggtgggttacgtagacttacgactccgtaacttaccggtcgttacggaacgtacggggaacctacggggtcctacccgtccgactccgaccgacccgaacgaccccaaccgtccgtacgtacctacgtccctcggtcccctcccc

SEQ ID NO: 433699 - DNA, 592 bp, Homo sapiens
  misc_feature: GZ8MTXP02H94EX.4.57.F02.1.454.CMB.2.raw
  modified_base (299)..(299): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataacctgtgtggaaccagcagtacggaaggtaaaagtgtaacagttggacaggcagaagccaggccaggcccctggtggtggtccgtcgttangatgcgaccggcctcgagggactcccgtgacgcgtattctcgtcggcctcctaactcgtacgggaacaccggcccaccgtcgaccatcacgacgagggtacgaagggcccggggataggacggacccgtaacttacgttacgtgacgtagggtggtagggagttaggtaggttggtagtagtacacgtaccagttacgtcgttacggacgtacgggacctaacggtcctccgtctacgtcgacgacccgacggacccaacccgactcgtacactcctccgttacccctacccc

SEQ ID NO: 433700 - DNA, 802 bp, Homo sapiens
  misc_feature: GZ8MTXP02HOIX7.4.57.F02.1.454.CMB.2.raw
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcacgtgggtccgccaggcctccaggcgaagggggctggaagtgggtgctagttatagtggtttgataggaaactaacaaattctatgacagacctcggtagaacgggccgtattccaacctatcctaccgagagaactaagtttcgaacgaaactactattagaaacttctaaacagactagaaactagttacgtaggaacggacgaccgggaaggaccgaacgggtcttaggttacttaagtttagttggtaggtacggtaaggtaaagggttaaaggttggttacgtaaggtttcggtttacctttttacgggaccgtagggtccgggggacccgtaaacgggggtaaacccccgtttcgggtacccgtaaccccggttccgttaccccgttaccgtaccggtaccccgtttaccccgaaaccccggtaaacccggggtacccctaaccggtttccccgggtttacccccgtttccccccgggtacgggtcccccgtacccccggttacgtcccccgttacccgaaccggggaacccgtaccccgtaaccccggtttccggggtaccgggggacccaaccgggtacccgggtcccccggggg

SEQ ID NO: 433701 - DNA, 668 bp, Homo sapiens
  misc_feature: GZ8MTXP02G93SX.4.57.F02.1.454.CMB.2.raw
  modified_base (218)..(218): a, c, t, g, unknown or other
  modified_base (225)..(225): a, c, t, g, unknown or other
  modified_base (297)..(297): a, c, t, g, unknown or other
  modified_base (373)..(373): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacgcaggataactgtgnggaaccngcagtcggaaggtaaagtgtacagttggtacaggcagagccgaggcacggcccctgtggtggtcgtcgttangagtacgcgaccgcctcgaggactcccgtgacgcgtattcccgtcgtacggcctacccaacgtcgtaacgggaccnccggacccacccgtacgacccatcgacgacgacggggtacgaagggccggggaatcggacggcccgtaagttaacgttacgtcggtacggtaggggtaggtaggggtaagttaggtaagggttggggtaactacgttacgtaactacccgtaaagtttccggttacgtaacgggtaaccgtacggggtaaaccctaacggtcccgtacccgtaccggttaaccgaccgaaccggaccccgaaaacgggtccccctaaaacccgtcccgtaacccgtcgtaccctaccgtttcccg

SEQ ID NO: 433702 - DNA, 705 bp, Homo sapiens
  misc_feature: GZ8MTXP02G0W72.4.57.F02.1.454.CMB.2.raw
  modified_base (266)..(266): a, c, t, g, unknown or other
  modified_base (299)..(299): a, c, t, g, unknown or other
  modified_base (317)..(317): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccaggcagacggcaggataaccgtgtgtaggaaccagacagtacggaaggtaaagtgtacagttaggtacaggcagaanccgaggccacggcccctgtggtgtcgtcgttangatcgcgaccggcccgtnagggactcccgtagacgccgtattctcgtcggcctaccaacctcgtagggaaccacggccctaccctcgaccactacgacgcggaacgggtacgggaacgggccgggggtaagtacgggacgggacccgtaagttaacgtaacgttcgggtacgagggttggtaagggtagttaaggttagggttggtagtacgtactaacgtacgttacgttaacgttccggttaccggtaaacgggttacgggaaaaccccgttaacggggttccctacccggttacccgtttaaccggacccggaaaccgcccccggtaaaaccgacccccgaaaacccccgttacgtccggtaccctaccggtttcccttaccccgtttccccctaaacccccc

SEQ ID NO: 433703 - DNA, 543 bp, Homo sapiens
  misc_feature: GZ8MTXP02JLS5D.4.57.F02.1.454.CMB.2.raw
  modified_base (362)..(362): a, c, t, g, unknown or other
  modified_base (445)..(445): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtcgttatgatagcgaccggccctcgagggactccctgacgcgtattcgtctcggctccaactcgtacggggaaccncgggcccaccctgaccatcagcagggtcgaagccggggatggaggccgactattacgtgtacaggtgtgggatagtagtggtnagtcatccgatacgtcttacggacgtgggacctaaggtctcccgtacacgtccacgcccgaaggcccaacccgctacgtccactcctcgttcccaccc

SEQ ID NO: 433704 - DNA, 614 bp, Homo sapiens
  misc_feature: GZ8MTXP02FQOHT.4.57.F02.1.454.CMB.2.raw
  modified_base (402)..(402): a, c, t, g, unknown or other
  modified_base (485)..(485): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggccccagggcagacggccaggataacctgtgtgggaaccagcagtacggaaggtaaaagtgtaacagttggtacaggcagaaagccgaggccacggcccctgtggtggtcgtccgtatgatgcgaccggcctcgagggactcccgtgacgcgtattccctcgtcggctacctaactcgtacgggaccgaccggccacccgtgaccatcgagacgnggggtacgaaggccggggatgggaacggacccgtaactacttacgtgtcgtaaggtggtaggggtatagggtaaggtgggtanaacgtcacgtactagtacgttcgttaacggaacttacggggacctaaaggttcctaccggtacctaccggtacacgtaacccgaacggaaccctaaaccgtacccgaactcggtactaaccgtttcccg

SEQ ID NO: 433705 - DNA, 549 bp, Homo sapiens
  misc_feature: GZ8MTXP02JJPBT.4.57.F02.1.454.CMB.2.raw
  modified_base (322)..(322): a, c, t, g, unknown or other
  modified_base (451)..(451): a, c, t, g, unknown or other
tcagagcactgtagcacgaccggtgctcgatttagctcgatataggttgggtttgggggcctaaggaagcagcactggtggtgcctcagccatggcctggaccgttctcctcctcggcctcctctctcactgcacaagctctgtgacctcatatgtgctgactcagccacctcagtgtcagtggcccaggcagacggccaggatacctgtgtgggaaccagcagtcggaaggtaaagtgtacattggtacaggcagaagccaggccaggcccctgtcggtggtcgtccgttatgatagcgaccggcctcgagggactcccgngagcgtattcctcgtcggcctaccaactcgtggggaaccacgggcccaccctgaccatcagcaggggtacgaaggcccggggatggacggccgactagttactgtcagggtgtgggataggtagtggtnagtcactcagtacgtcgttcggaacgtgggacctaaggtcctccgtactacgtcacgcccaaggacccaacccgctacgtcactctcgtcccgtcccc

SEQ ID NO: 433706 - DNA, 601 bp, Homo sapiens
  misc_feature: GZ8MTXP02FFC9P.4.57.F02.1.454.CMB.2.raw
  modified_base (173)..(173): a, c, t, g, unknown or other
  modified_base (220)..(220): a, c, t, g, unknown or other
  modified_base (251)..(251): a, c, t, g, unknown or other
  modified_base (293)..(293): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcagtcgccccaggcagacggccaggatacctgtgtggaaccngcatcggaaggtaaaagtgtacattggtacnggcagaagccaggccaggcccctggtggtggtcgtccgttangatagccgaccggcccctgagggactcccgtgacgcgattctctggcctccgaactcgtacgggaaccacggccaccctgaccatcagcagggtacgaacggtccggggatgacggcccgactagttacaggtcagggtgtagggataggtagtggtagatcagtacccagttaccgtcgttacggaacgttcggggaacccgtaaggttccctccgggttaccctacggtacctacgggaccccaacgggtacccccaaacccccgagttccggtaccacccttctacccgttccccctaacccccg

SEQ ID NO: 433707 - DNA, 671 bp, Homo sapiens
  misc_feature: GZ8MTXP02FJOBD.4.57.F02.1.454.CMB.2.raw
  modified_base (377)..(377): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcagtcggaaggtaaaagtgtaacagttggtacaggcaagaacgccgaggccacggcccctgtggtggtcgtccgtatgatagccgaccggcctcgagggactcccgtgagcgtattcccgtcgtcggcctccaactcgtacgggaccnccggaccacctcgaccatcgagcgagggtacgaaggccggggatcggacggccgtaacttagttacgtagtacgtagggtggtaggggtataggtaggtgggtagtactacgacttaccgtaacgttacggttaccgttaccggggaaaacgttccgggggtaaaacccgtaacgggttacccgttacccgggttacccgtaaccggttacccgaaaccggtacccccgaaaacggggtccccctaaaaccgttcccgaacccgtttacgttaccccgtaaccctttcccccgg

SEQ ID NO: 433708 - DNA, 610 bp, Homo sapiens
  misc_feature: GZ8MTXP02GOBNQ.4.57.F02.1.454.CMB.2.raw
  modified_base (223)..(223): a, c, t, g, unknown or other
  modified_base (366)..(366): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggatactgtgtggacngcatcggagtaaagtgtaacattggtacaggcagaagccgaggccgacggcccccgtggtcggtcgtccgttatgatagccgaccggcctcgagggactccctgacgcgtattctccgtaggcctccaactcgtacgggaacnccggccacccgtgaccatcagcgaggggtacgaacggccggggagtcggacggggacccacgttactacgtggtacgagggttagtgggtagttaggtaggttgggtagatcgaacttcagttacgttacgttaccggaaacgtcggggaaccgtaacggtccttacccggtacccgttacgtccaccgacccgtaaccggaacccaactacccgtacgtcgtaccctaccttctttacccccg

SEQ ID NO: 433709 - DNA, 685 bp, Homo sapiens
  misc_feature: GZ8MTXP02HTLYB.4.57.F02.1.454.CMB.2.raw
  modified_base (413)..(413): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggactaaccgtgtgtagggaaccagcatcggaaggtaaagtgtacagttggtacaggcagaacgccaggccaggcccctggtggtgtcgtcgtatgatagcgaccggcctcgagggactcccgtgagcgtactctcgtcgcctccaactcgtaggaccacggcccacctgaccactcgagacggtacgggcgaaacgggtccggggganacggggacggcccgtaacttacgttaaccgttggtaccgtaggggtggttaggggtaaattagggttaagggttgggttaggtacgtacgtaacttccgtaaacgttaccggtttacgtttaccggggaacgtacgggggtaaccttaaacgggttccgtttacccgtacccgtttaccgtaccgaccggtacccccgaaaccggcccaaaaccccccggttacgtacccgttacctacccgtttcccgttccccgtttaccccctaccccg

SEQ ID NO: 433710 - DNA, 664 bp, Homo sapiens
  misc_feature: GZ8MTXP02IQWSE.4.57.F02.1.454.CMB.2.raw
  modified_base (225)..(225): a, c, t, g, unknown or other
  modified_base (241)..(241): a, c, t, g, unknown or other
  modified_base (292)..(292): a, c, t, g, unknown or other
  modified_base (356)..(356): a, c, t, g, unknown or other
  modified_base (364)..(364): a, c, t, g, unknown or other
  modified_base (400)..(400): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtgggaaccngcatcggaggtaaagngtacattggtacaggcagagccaggccaggcccctgtggtgtcgtccgtangatgcgaccgcctgaggactccctgacgcgtattcgtctcggcctccaactcgtgggaaacccncgccaccncgaccatcgacgcgacgggtacgaagggccggggancgggacggaccgtacttacgttacgtggtacgtaggggttgggtacggggtaagttaggttagggttcggtagtacgtactacgtaccgtaacgtttaccggttacgttacgggtaaacggtcgggggtaaacccgttacgggttccccgttacccggttacccgttaaaccggtccgacccggaaccccgtaaccggaaccccctaaaccccgtacgttaccgtaccctacccgtttccgtttccccggttcccccgtacccc

SEQ ID NO: 433711 - DNA, 674 bp, Homo sapiens
  misc_feature: GZ8MTXP02IWLSU.4.57.F02.1.454.CMB.2.raw
  modified_base (294)..(294): a, c, t, g, unknown or other
  modified_base (358)..(358): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcagtcggcccagggcagacggccaggactaacctgtgtgggaaccagcagtcggaaggtaaaagtgtacattggtacaggcagaagcaggccaggcccctgtggtgtcgtcgttangatgcgaccgcctgacgggactccgtgacgcgtattctcgtcggcctccaactcgtaggaaccnccggccaccctgaccatcgagcgagggtacgaaaggccggggatgggaacggtcccgtaattacgttaacgtcggtacgtaggggttggttggggtaaattagggtaaggttcgggttagtattaccgaacgttacctaaggttaccgttaccggttacggggtaaaacgtcgggggtaaaaccccgtaacgggtttcccgttaccccggttacccgttaaacggtcccgaaaccggacccccgtaaacgggacccccaaaaccccggtctacggttacccaaccgttcccttaccccggtttcccctaacccccg

SEQ ID NO: 433712 - DNA, 742 bp, Homo sapiens
  misc_feature: GZ8MTXP02J0C76.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataaccgtgtgtgggaaccagcagtcggaaggtaaagtgtacagttggacaggcagaacgccaggccacggcccctggtggtggtccgtcgttagtgatacggcgaccggcctgagggactcccgtgacgcgtattctcgtcggcctacctaacgtcgtacggggaaccaccgggcccacccgtacgaacccagtaccgacggacgaacgggggtacccgaaacggggcccgggggtaacgtacggggaacgggtacccgtaacgttaacgtttaacccgttcggtacggtagggggttagggttagggggtaaagtttaaggggttagggttagggttacggtattaccgtaagttcccgttaagttaccggtttaccgtttaacgggaaccggtttacggggaaacccttaacggggttcccgttaccccggttcccgtaaaccggtccaaccggacccccgaaacgggtacccccaacccccgtacgttaccggtacctaccgtttcccgttcccgggttaccccctcccccg

SEQ ID NO: 433713 - DNA, 550 bp, Homo sapiens
  misc_feature: GZ8MTXP02FMKJH.4.57.F02.1.454.CMB.2.raw
  modified_base (294)..(294): a, c, t, g, unknown or other
  modified_base (360)..(360): a, c, t, g, unknown or other
  modified_base (414)..(414): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaaagtgtacattggtacaggcagaagccaggccaggcccctgtggtgtcgtcgttangatagcgaccggccctcgagggactccctgagcgattctcgtcggctaccaactcgtgggaaaccncggccacctgaccatcagcagggtcgaaggccggggatgaggccgactattacngtcgaggtgagggataggtaggtggtagatcactcagtcgtcgtaccggaacgtcgggaacctaaggtcctccgttccacgtcacgtacccaacggacccaaacccgactacgtccactcgtccgttcccctcccc

SEQ ID NO: 433714 - DNA, 614 bp, Homo sapiens
  misc_feature: GZ8MTXP02IYEQQ.4.57.F02.1.454.CMB.2.raw
  modified_base (220)..(220): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggcaggataacctgtgnggaacagcatcggaaggtaaagtgtacattggtacaggcagaagccaggccaggcccctgtggtgtcgtcgtatgatagcgaccggccctacgagggactcccgtgagcgtattccctcgtcggcctaccaacgtcgtacgggaccaccggacccaccccgtgacccatcgagacgagggtcgacggccggggatgacggccgtatacgtacgtagcgtagggtggtagggtagttaggtaggtgggtagtacgtcgtactactaacgttaccggtacgtttacgggaacgtttacgggggaacccgtacggtccgttcccggttaccgtaccgttacgacccggaccccgaacggtacccaaccgttcccacgttcgtacctaccgtttcccg

SEQ ID NO: 433715 - DNA, 684 bp, Homo sapiens
  misc_feature: GZ8MTXP02FRPMD.4.57.F02.1.454.CMB.2.raw
  modified_base (294)..(294): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaaggtaaagtgtacattggtacaggcagaagccaggccaggcccctggtggtggtcgtcgtangatagcgaccggccctgagggactcccgtgacgcgattctcgtcggcctccaactcgtacgggaaccaccgggcccacccgtcgaacccataccgagaccgaggggtaccgaaacgggcccgggggatacgggacgggacccgtaacgttacgtttacgtcggtacgaaggggttggtagggggtaattaggggttaaggtggggtagtaacgttacgaacttcccgtaagttacccggttacgtttaccgggaaacgttacggggaaccctaaacgggttcccttacccggtaccgttaaccggtaccgacccgtacccccgaaacgggacccccaaacccccgtacgtaccggtaccctaccttccgtcccgttaccccccgtccccc

SEQ ID NO: 433716 - DNA, 605 bp, Homo sapiens
  misc_feature: GZ8MTXP02HFUSU.4.57.F02.1.454.CMB.2.raw
  modified_base (301)..(301): a, c, t, g, unknown or other
  modified_base (599)..(599): a, c, t, g, unknown or other
tcagagcactgtagcacgaccggtgctcgatttagctcgatatagttgggttgggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctggtgtgggaaccagcagtcgggaaggtaaaagtgtacagttggacaggcagaagccaggccacggcccctgtggtggtcgtcgttangatagccgaccggcctacgagggactcccgtgacgcgtattcccctcgtcggcctaccgaaactcggtacggggacccgaccgggacccaccccgttgaacccagtcgacggtcgacggggtaccgaaagggcccgggggaatcgggacggtcccgaacttagttacgtgtacgagggtggtggaagttgtaggtgggtagacttcgatcctagttacgttcgtacggaacttacgggacctagggtcctccggtactaccgcgaccgtaccgaacggaccaacgtcctactcgtacncttccc

SEQ ID NO: 433717 - DNA, 752 bp, Homo sapiens
  misc_feature: GZ8MTXP02HDJAR.4.57.F02.1.454.CMB.2.raw
  modified_base (149)..(149): a, c, t, g, unknown or other
  modified_base (216)..(216): a, c, t, g, unknown or other
  modified_base (222)..(222): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcacgcccaccctcagtgtcagtcggcccgagggcagacggcaggatacctgtgnggaacngcagtacggaaggtaaaagtgtaactagttggtaacaggacaagaacgcgacggccacggccccgtggtcggtcggtcgttcgttagtgagtacggccggtacccggccgtacggacgggactcccgtagacgcgtacttcgtcgtcggacctaccaacgtcggtacggaaaccaccggcccaaccgtcgaaccacgtacgaacggcggaacggggtaccggaacgggccggggaatcgggaacggacccgtaagttaacgtttacgtagtacggtaaggggttcgggtaaggggtagttaagggtacgggtttggggtagtaacgttaccgtaacgttaacccgtaaggtttacccggtttcggttaaacgggtaaaccgggttaacggggtaaccccgtaaacgggtttcccggttacccggttaccccgttaaacggtccggaacccgtaaccccgaaaccggacccccaaacccgtacgtccgttaacccgtacccgtttccccggtaccccgtacccccgttccc

SEQ ID NO: 433718 - DNA, 622 bp, Homo sapiens
  misc_feature: GZ8MTXP02I55G4.4.57.F02.1.454.CMB.2.raw
  modified_base (295)..(295): a, c, t, g, unknown or other
  modified_base (308)..(308): a, c, t, g, unknown or other
  modified_base (321)..(321): a, c, t, g, unknown or other
  modified_base (376)..(376): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggcaggataacctgtgtaggaaccagcagtcggaaggtaaagtgtactattggtacaggcagaagccaggccacggccctggtggtcgtcgtcgttangatgcgaccgccncgagggactccgngacgcgacttctcgtcgcctaccacgtcgtaggaaccgcggcccaccctgaaccntacgacgacgacgggtacgaaggccggggatcgggacggcccgtaattacgttacgtcggtacgtagggttgggtagggtaagttacgggttagtacgggtgacgttcaacttccgtaagttccggttacgttaccggtaacggtcggggaaccgtaacggtcttcccggtaccttacggtaccacgaccccgaacggtccccgaaaccctcggtctaccctactccgtccgtttacccctacccc

SEQ ID NO: 433719 - DNA, 790 bp, Homo sapiens
  misc_feature: GZ8MTXP02FUD3O.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacccccagtgtcagtcggcccagggcagacggccaggataacctgtgtagggaaccagcagtacggaaggtaaaagtgtacagttggacaggcaagaacgccgaggccacggcccctggtgggtggtccgtccgttatgatacggccgaccggccctgacgggactcccgtggacgtcgtattctcgtcggccctacctaactcgtacggggaaaccaccggacccctacccgtcgaacccagtaccgacggtacggaaacgggggtaccggaaacgggggtcccgggggaagtacggggaacggacccgtaacgtttaacgttaccgtcggttacggtaggggttagggtagggggtaaattaaggggttaagggttgggttacgtacgttaccgtaacgttacccgtaggtttaacccggttaccggtttaaacggggaaaccggttaacgggggtaaacccgttaaaccggggttacccgttccccggttaacccgttacccgggtaaccgaacccggtaacccccggaaaaccgggaccccctaaaacccccggtaacgttaccggtaccctacccgttcccgtttacccccgtaccccctaaacccccgtttccccc

SEQ ID NO: 433720 - DNA, 595 bp, Homo sapiens
  misc_feature: GZ8MTXP02HJ6HY.4.57.F02.1.454.CMB.2.raw
  modified_base (292)..(292): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggcccaggcagacgcaggataactgtgtggaccagcagtcggaaggtaaagtgtacattggtacaggcagaagccaggccaggcccctgtggtggtcgtccgttangatagcgaccggccctcagggactccctgagcgtattcctcgtggcctccaactcgtcgggacacggccaccctgaccatcagcgagggtcgaaggccggggatggacggccgacttagtacgtgtacgagggttggtagggtattaggtaggttgggtagattacgaactccgaagttaccggtacgttacgggaaacgttcggggaaccctaaacggggttcccttacccggttacccgttacgtaccgaacggaccccgaaacggcccaaaccgtcccaacgtcgtaccctacgtttccc

SEQ ID NO: 433721 - DNA, 642 bp, Homo sapiens
  misc_feature: GZ8MTXP02IB124.4.57.F02.1.454.CMB.2.raw
  modified_base (217)..(217): a, c, t, g, unknown or other
  modified_base (226)..(226): a, c, t, g, unknown or other
  modified_base (305)..(305): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggactaactgngtggaaccngcagtcggaaggtaaaagcgtaacagttggtacaggcaagaacgccgaggccacggcccctggtggtggtcgtcgttangatagcgaccggccctgaggactcccgagacgcgtattcctcgtcggctaccaactcgtacgggaccaccggaccacccgtcgaccatcagccgagggtcgaaggccggggatcggacggaccgtactacgttacgtgtcgagggtggtaggggattagggtagggttgggtagtactacgacttaccgaaggtttaccgttacgttaccgggtaacgtacgggggtaacccgttaaacggggttccttaccccggtacccgttaaccggtccgtaacccggacccgaaacggacccctaaccgttacccacgttaccgtaccttaccgtttccccg

SEQ ID NO: 433722 - DNA, 668 bp, Homo sapiens
  misc_feature: GZ8MTXP02G96S3.4.57.F02.1.454.CMB.2.raw
  modified_base (273)..(273): a, c, t, g, unknown or other
  modified_base (278)..(278): a, c, t, g, unknown or other
  modified_base (291)..(291): a, c, t, g, unknown or other
  modified_base (320)..(320): a, c, t, g, unknown or other
  modified_base (376)..(376): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagcttgggttttcctcgttgcttcttttaagaggtgtccagtgtcaggtgcaccgtggtggaggtcggggggaggcggtggtccgaggcccggtggggggtccctggagacctctcctgtgcngcgtntggattcgccttnagtgcctatggcatgccacgtcgggtccncaggctccgaggcgaaggggctaggaagtggggtgctaggtttatagttgggtttnagtacggaaacttaaacaaattctaagtgcgaacgtaccgttccggagggaaacgggcccgtattcccactactctacccgaagacgactaaattacgaagaaactactattaagaacttactaacgagtaagtagaaactacggtactagggaacgacggaccggaagggaacccgacgggtacttcggttaacttaacgtttaacgttcggtaccggtaacggtaaggttaaacgggttaacggttaggtaccgttaaagggtttccggttttaccccgtttaaacgggg

SEQ ID NO: 433723 - DNA, 589 bp, Homo sapiens
  misc_feature: GZ8MTXP02JQWA8.4.57.F02.1.454.CMB.2.raw
  modified_base (288)..(288): a, c, t, g, unknown or other
  modified_base (462)..(462): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaagtgtacattggtacaggcagagcaggccaggccctgtggtgtcgtcgtangatagcgaccgcctcgagggactccctgagcgtattctctcggcctaccaactcgtagggaaccacggcccacctgacccatcgagcaggggtcaaaggcccgggggatcgggaacggcccgtaattacgttaaccgtggtcgaggttggtagggattagggtaggtcgggtanatacacgtccgtagttaccgtcgtacggacgtcgggaacctacggttcctaccgtaccgtacgtaccgaccgacccgaaccggacccaacccgtctacgtacctaccttccgtacccgtccccgccc

SEQ ID NO: 433724 - DNA, 691 bp, Homo sapiens
  misc_feature: GZ8MTXP02JJWXZ.4.57.F02.1.454.CMB.2.raw
  modified_base (205)..(205): a, c, t, g, unknown or other
  modified_base (256)..(256): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggagcgtggtccagcctggggggtccctgagactctcctgtgcagcgtctggattcgccttcagtgcctatggcatgcacgtgggtccnccaggctccgaggcaaggggctgggaatggggtgctagttatagttggttnagtaggaactaacaaattctatgcagactccgtaggaacggccgtattcgacctaatcctaccagagaactaatttcgaagtaaacactattagaaatctaacagtaactagaaacctagttacgagaacggacgaccggaggaacacggtaccgttgttacgttaatttagttgggtagtaggtaaggtaaggttaaggtggactagttcgttcgttttacggacgtaggtacggggaccgtaaccgggggtaaacccgttcggtaccgtacccggttctacccgtacctacggtcccttaccgaaaccgacggggtaccctacgttcccggttcccgttacccccggtcggtcccgccccgttcgacccgttccgaaacggcggaacccgtacccgttcgggacgggggacaccggaacggtcccggccccgg

SEQ ID NO: 433725 - DNA, 714 bp, Homo sapiens
  misc_feature: GZ8MTXP02GQQW0.4.57.F02.1.454.CMB.2.raw
  modified_base (173)..(173): a, c, t, g, unknown or other
  modified_base (208)..(208): a, c, t, g, unknown or other
  modified_base (216)..(216): a, c, t, g, unknown or other
  modified_base (245)..(245): a, c, t, g, unknown or other
  modified_base (319)..(319): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctnagtgtcagtcgcccaggcagacgcaggatacgtgngaggaacngcagtacggaagtaaagtgtactgtgganaggacagaacgccaggccacggccctggtggtcgtcgtcgttatgactacgccgaccggcctcgaggactccgngacgcgtactcgtcgccgcctaccgaacgtcggtacgggaaccacccggcccacccgtacgaacctacgaccgaacggtacgggaacgggggtaaccgggaaacggggtaccccgggggtaagtacggggaaacgggtaacccgttaaacgtttaacgtttaccggtaggtacgggttaggggtagggttaacggggtagttaagggtttcgggtaaggtcgttacttacgtaaccgtaccgttaacgttaccggtttaccggttaacgggtaaccggtacggggaacccgttaacggttcccgtacccgtccgttaaccgccgaacccgaacccgaaccgtacccccgaaccctacgtcgtaacctccgtacccgtttccgttaccccctaccc

SEQ ID NO: 433726 - DNA, 590 bp, Homo sapiens
  misc_feature: GZ8MTXP02JIGJX.4.57.F02.1.454.CMB.2.raw
  modified_base (258)..(258): a, c, t, g, unknown or other
  modified_base (348)..(348): a, c, t, g, unknown or other
  modified_base (414)..(414): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtcccgccaggcctccgaggcaagggggctgggaatggggtgcagttatattggtttnagtggaactaaacaaattctatgcagactccgtagaaggccattcaccatctccagagactaatttcgaagaacactattgaaatctaanagatacgaaacagtctagagacgccgaggacacggctgtctatttagtgtgcgagagtaagtggtntagtggttcctttgaccgtagtggggacctacgggtaacccgtggtccaccggttcctacctcgacgtccttacccaacgaaccggcccacgtccgtcccttcccccgtgggccccgtcccgtcgccctaccgacggtacgccgtacccgtcggcggggcacgcggccggtcccgg

SEQ ID NO: 433727 - DNA, 594 bp, Homo sapiens
  misc_feature: GZ8MTXP02FI2TE.4.57.F02.1.454.CMB.2.raw
  modified_base (357)..(357): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaaggtaaaagtgtacagttggtacaggcagaagcaggccaggcccctggtggtggtcgtccgttatgatagcgaccggcctcgagggactccctgacgcgattctctcggctccaatcgtgggaacncgggccaccgtgacatcagcaggggtcaaagggtccgggatggacggcccgactattacgtgtcagggttgtagggataggtagtggtagtagctacgtaccgaattaccggttcgtacggtaacgtcggggaacctaacggtcctacccgtaccgtaccgtcaccggacccgaacgggtacccccaaaccccgtacgtaccgtccctaacgttccgttcccggtcccccgtccccc

SEQ ID NO: 433728 - DNA, 742 bp, Homo sapiens
  misc_feature: GZ8MTXP02IUMT0.4.57.F02.1.454.CMB.2.raw
  modified_base (150)..(150): a, c, t, g, unknown or other
  modified_base (176)..(176): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctnatatgtgctgactcacgcccaccctnagtgtcaggtcggccccgagggcaggaccggccaagggtaactaaccgtggtggtacgggaaccaggcaagtacgggaaggtaaaagtgtaacagttggaacaggcaggaacgccgacggaccgacggccccgtggtgggtcggtcgtccgtatggagtacggccgacccggccctacggacggggtactcccgtagacggcgttacttcgtcgtaccggtactacccaacgttcggtaacggggaacccgtacccgggacccctacccgtacggaacccacgttaccgacggaccgggtaacgggggaccggaacgggggacccggggaagtacgggacgggacccgtaaacgtttacgttacgtcgtacgggtagggtaggtaggggtaagttagggtaggttggtacgtagtacgtacgttaccgtagttaccgtcggtttaacgggaacgtaggggaacccgtaacggtccgttccgtacgtaacgtccggaccgaacccgtaccggacccctaacccgtaccgtcgtaccgaccttaccggttacccttacccctaccccg

SEQ ID NO: 433729 - DNA, 678 bp, Homo sapiens
  misc_feature: GZ8MTXP02I7X56.4.57.F02.1.454.CMB.2.raw
  modified_base (205)..(205): a, c, t, g, unknown or other
  modified_base (432)..(432): a, c, t, g, unknown or other
  modified_base (519)..(519): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccnccaggctccaggcaagggggctggaatggggtggctagttatatggtttgataggaactaacaaattctatgcagactccggtagagggccgattccaccatcctaccagagactaatttcgaagaacacattagaactctaacagatacgaacagtctaggacgagaccggagggtaccacgggtccttgttcttaatttagttgtagtacggtaaggtaaggttnaaacgttagggttcgactttagaccgggtaccttttgggggacccccaaggggttaacccgggtccggtacgggaaacccccgcggnttccgtacccgtacgtacccttccaccgtaccggtacccctaaccgtaccgggtcccgtaccccgtccggtcccgtcccccgtccggcccgtccccgtacggaccgtaacccgaccggtaccgtaccgggtacccgtccggtacggggaccggtacccg

SEQ ID NO: 433730 - DNA, 555 bp, Homo sapiens
  misc_feature: GZ8MTXP02FF23T.4.57.F02.1.454.CMB.2.raw
  modified_base (318)..(318): a, c, t, g, unknown or other
  modified_base (513)..(513): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagccgtggggggtccctgagactctcctgtgcagcgtctggattcgccttcagtgcctatggcatgcacgtgggtccgccaggctccgaggcgaaggggctggaatggggtgctagttatatggtttgataggaaactaacaaattctaatgcagactccgtagaacggcatcaccatctcaganactaatttcgaagaacacattagaatctaacagatagaacagtctagagagccgaggacagctgtctattatgtgcgagagtagtgtcagtgttctttgaccgtaggtacgggccgacgggtaaccctggtaccaccgtctccctacacgctaccaaccgaacggcccaacgtccggtcccttccccgcggcccncctcgcctcgacgcgccgtactcggcggggcaacgcgcccgg

SEQ ID NO: 433731 - DNA, 592 bp, Homo sapiens
  misc_feature: GZ8MTXP02GL7ND.4.57.F02.1.454.CMB.2.raw
  modified_base (217)..(217): a, c, t, g, unknown or other
  modified_base (222)..(222): a, c, t, g, unknown or other
  modified_base (248)..(248): a, c, t, g, unknown or other
  modified_base (290)..(290): a, c, t, g, unknown or other
  modified_base (362)..(362): a, c, t, g, unknown or other
  modified_base (475)..(475): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacagtctctgtgacctcatatgtgctgactcacgcccaccctcagtgtcagtcggccccaggcagacgcaggatactgtgnggacngcatcggaagtaaagtgtacatgganaggcagaagcgagccacggcccctgtggtggtcgtccgttangatacgcgacccggccctgagggactcccgtagagcgtattccctcgtggctaccaactcgtacggggaccnccggacccacccgtcgacccatccgagcgaaggggtccgaaggccggggatcgggacggaccgtaacgttactacgtagtcgtaagggtggtagggagttaggtagtgggtanactcgactcctaagtacgtcgtacggaacgtacgggacccgtaaggttccctccgtaccgttacgaccgaccgtacccgaaggcccctaaactcccacgtcgtacctacgtttcccg

SEQ ID NO: 433732 - DNA, 588 bp, Homo sapiens
  misc_feature: GZ8MTXP02GXMF1.4.57.F02.1.454.CMB.2.raw
  modified_base (225)..(225): a, c, t, g, unknown or other
  modified_base (232)..(232): a, c, t, g, unknown or other
  modified_base (305)..(305): a, c, t, g, unknown or other
  modified_base (398)..(398): a, c, t, g, unknown or other
  modified_base (475)..(475): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtcggccccgagggcaggacggccaggactaacctgtgnggaaccngcagtcggaaggtaaagtgtacattggacaggcagaacgccgaggccaggcccctggtggtggtcgtcgttangatacgcgaccggcctcgacgggactcccgtgacgcgtattccgtcgtcggcctaccacgtcgtacgggaccaccggccacccgtcgacctancgagcgagggtacgacggcgggatcggacgccgtactagtacgtgtacgaggtgtagggattaggtagtagggtaanacgtacgactcgtagttccgtacgtacggaacgtacggaccgtacgtccgtaccgtacgtacgaccgaccgaccgaacgaccctaaccgtccacgtaccgtacctaccgtccg

SEQ ID NO: 433733 - DNA, 549 bp, Homo sapiens
  misc_feature: GZ8MTXP02H8O9F.4.57.F02.1.454.CMB.2.raw
  modified_base (250)..(250): a, c, t, g, unknown or other
  modified_base (326)..(326): a, c, t, g, unknown or other
  modified_base (381)..(381): a, c, t, g, unknown or other
  modified_base (396)..(396): a, c, t, g, unknown or other
  modified_base (443)..(443): a, c, t, g, unknown or other
tcagagcactgtagcacgaccggtgctcgatttagctcgatatagttgggtttggggggaagaggaagactgacggtcctcccaggtgtcagtgtcaggtgcacctggtggagtcgggggggaggcgtggtccagcctggggggtccctgagactctcctgtgcagcgtctggattcgccttcagtgcctatggcatgcactgggtccgccaggctccaggcgaaggggctggaatggggtggcagttanagttggtttgataggaactaacaaattctaatgcagactccgtagaggccattcacatctcagagacaattcgaanaacactatgaaatctaacagatagaaactagtctagagacgccgaggacacggtntgtactattatgtgngagagtagtgtactagtgtcgttgtacgagtgggacgacggtaccgngtttttcgacgtctctacacgtctacacgacgaccgacgtcgtccttcccgtcgccgccgtcgccgtccgacggaacgacaccgtcggtcgggacgacgacgccgg

SEQ ID NO: 433734 - DNA, 699 bp, Homo sapiens
  misc_feature: GZ8MTXP02JVFAH.4.57.F02.1.454.CMB.2.raw
  modified_base (230)..(230): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggacggccaggactaacctgtgtgggaaccngacagtcggaaggtaaaagtgtacagttggaacaggcaagaacgccgaggccacggcccctggtggtggtcgtcgtatgatagccgaccggcctgaggactcccgtagacgcgtacttccgtcgtcggacctaccgaaacgtccgtaacggggaacccaccgggaaccccctacccgtagaaacccacgtaccgaacggaccggtaaacgggggtaaccggaaaacggggccccgggggaattacggggaaacgggaccccgtaaattaacgttaaccgtgggtaccggtaaagggttggtaagggtagttaagggtaggttacgggtagtacgttacgaacttaccgtaagttaccgtacgtttacggaaacgttcgggaaaccctaagggtccctccggttaaccctacgaccgaccggacccaaacggacccaaccgtacccaacgtccgttaaccctaccttccg

SEQ ID NO: 433735 - DNA, 658 bp, Homo sapiens
  misc_feature: GZ8MTXP02FW9E7.4.57.F02.1.454.CMB.2.raw
  modified_base (228)..(228): a, c, t, g, unknown or other
  modified_base (392)..(392): a, c, t, g, unknown or other
  modified_base (446)..(446): a, c, t, g, unknown or other
  modified_base (643)..(643): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctcagtgtcaggtcggccccgagggcagacggccaggataacgtgtgaggaacngcagtacggaaggtaaagtgtaacagttggtacaggcaaggaacgccgaggccacggcccctggtcggtggtcgtccggttatcgagtacggccggacccggtcctagacgggactcccgtagagcgtactccgtcgtcggctaccaacgtcgtaacgggaccnccggtcccaccgtacgacctatcgacgacgacggggtacgaacgggtccggganacgggacggccgtaaattacgttactgtcgtagggtggtagggtagttagggtaggtggtagtactacgtacttcgaacgttacgtacggttacggaaaccggtacgggtaaacccgtaacgggtttcccgtacccggtacccgttaacggacccgaaccgaacccgaacggacccctaaacgtcccgacgttaacnccgtactttaccccg

SEQ ID NO: 433736 - DNA, 753 bp, Homo sapiens
  misc_feature: GZ8MTXP02HN1R3.4.57.F02.1.454.CMB.2.raw
  modified_base (177)..(177): a, c, t, g, unknown or other
  modified_base (225)..(225): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctnagtgtcaggtcggccccaggtcagacgccaggactactgtgaggaccngcagtcggaaggtaaagtcgtacagtggtacaggacaagacgccgacggccacggtccccgtggtcggtcggtcgttaccgttatggactacggccggaccgccctaggacgggtactcccgagacgcgtattcccgtcgtcgacccttaccgaacgtttcggacgggaacccgacccgggacccctaacccgtacggaaccctactaaccggaacgggaccggtaacgggggaaccggaaacggggccccgggggtaaagtacccggggaccgggaacccggtaaacgtttaaacgttaccgggtacggttaccgggtaggggttacgggtaaggggttaagtttaaggggtaaggtttggggtaatacgttacgtaccgtaccgtaacgttacccggttcggttaaaccgggaaaccggttacgggaaccgttaaacggtcccgttaccggttaccctacggtacccaaccggaacccgaaacggtccctaaaccgtccgaacgtcctaccgtaacctttcccccg

SEQ ID NO: 433737 - DNA, 613 bp, Homo sapiens
  misc_feature: GZ8MTXP02FM0FU.4.57.F02.1.454.CMB.2.raw
  modified_base (300)..(300): a, c, t, g, unknown or other
  modified_base (404)..(404): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcaggtcggccccagggcagacggccaggataacctgtgtgggaaccagcagtcggaaggtaaaagtgtacattggtacaggcagaagcaggccacggcccctggtcggtggtcgtccgttangatacgcgaccggcctcgaggacgtcctgagcgatctgtcggctaccaactcgtaggaaccacggcccacctgaccatcagcgagggtacgaaggacccggggntacgaggaccgtactacgttaacgtggtcgaagggtgggtaggggagttaaggtaggtgggtagacgtctacgtctaagtaccggttcgttaccgggacggtaacggggacgtaaaacggttccgttcccggttaccgtaccggttcgaaccgaccccgaacggtacccccaacccgaactcgacctacttccgtccttcccctacccc

SEQ ID NO: 433738 - DNA, 678 bp, Homo sapiens
  misc_feature: GZ8MTXP02FL4XY.4.57.F02.1.454.CMB.2.raw
  modified_base (207)..(207): a, c, t, g, unknown or other
  modified_base (280)..(280): a, c, t, g, unknown or other
  modified_base (363)..(363): a, c, t, g, unknown or other
  modified_base (378)..(378): a, c, t, g, unknown or other
tcagagcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcacgtgggtccnccaggctccgaggcaaggggctagggaatggggtggctagttatagtggtttgataggaaactaactaaattntatgcagactccggtgaacggccgattcaccatcctccaagacgaactaagtttcgaagtaaaccactattagaaactctaanagtatagaactagtntagagacgccggaggaccacggtctgttactatttagtgtagcgtaagaagttaaggtcggttacgtagttcggtttccgttttacggaaccgtagggtccggggaccggtaacggggtaaacccgtcggtacccgtaaccggttccttcctaccgtacgttcccttacccgaacccgtaaaccggggtcccctacggttccccggttcccgttcccccgtcggccccgtccccgtcgtcccgtacccgacggaccgtccgacccggtcggtacggggaccaacgccggcccggtcccgg

SEQ ID NO: 433739 - DNA, 663 bp, Homo sapiens
  misc_feature: GZ8MTXP02HXBEJ.4.57.F02.1.454.CMB.2.raw
  modified_base (361)..(361): a, c, t, g, unknown or other
  modified_base (438)..(438): a, c, t, g, unknown or other
  modified_base (601)..(601): a, c, t, g, unknown or other
  modified_base (627)..(627): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcacgtgggtcccgccaggctccaggcgaaggggctaggaatggggtgctagttatagttggtttgagtaggaaactaaactaaattctatgacagactcggaggaacgggccatcacatctccagaagactaagtttcgaagaacactattagaaatcctaanagatagaactagtactagagacgccggaaggaacacgtacttgtacttatttagtgtagacgaaggtagttaacggngttactaggttcgtttcgtttacgacgtacggggcggggtaccgacggtacccgttcggaccctacccggtcctacccgtgaaccggttcccttacccgaaccggtaaccgggtacccctaaccggttccccggtttccccctttccccggtcggggtccccnccccgttcgcccgtcccgaggaaccncccgtacgtccgggcggggaccacggtccggcccgg

SEQ ID NO: 433740 - DNA, 514 bp, Homo sapiens
  misc_feature: GZ8MTXP02FWBH8.4.57.F02.1.454.CMB.2.raw
  modified_base (378)..(378): a, c, t, g, unknown or other
  modified_base (439)..(439): a, c, t, g, unknown or other
  modified_base (478)..(478): a, c, t, g, unknown or other
  modified_base (496)..(496): a, c, t, g, unknown or other
tcagagcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtgcagttatatggttgatggaactaacaattcatgcagactccgtgaaggcgattcaccatctcagagacaatttcgagaacacattgaatctaacagatagaacagtctagagacgccgagacaggctgtctattatgngcgagagtaagtgtacatgttcttgacagtgggacagggaccctggtccaccgtctccgtnacgtctaccacgacggcccagtccgtcctcccgtcgccncctcgcctcgagcgcacncggtgggcacgagcccgg

SEQ ID NO: 433741 - DNA, 749 bp, Homo sapiens
  misc_feature: GZ8MTXP02HH0WQ.4.57.F02.1.454.CMB.2.raw
  modified_base (175)..(175): a, c, t, g, unknown or other
  modified_base (217)..(217): a, c, t, g, unknown or other
  modified_base (327)..(327): a, c, t, g, unknown or other
tcagagcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagcccaccctnagtgtcagtcggcccagggcaggacggcaggataacctgtgngggaaccagcagtcggaaggtaaagtgtacagttaggacaggcaagaagccaggccacggcccctggtggtggtcgtcgtatgatagcgaccggcctagagggactccgngacggcgtacttctcgccggtcctaccaacgtcgtagggaaccaccgggcccaacccgtcgacccataccgacggacggtacgggggtacgaaacgggcccgggggtaaagtcggggaacgggtacccgtaacgttaaccgttaccggtggtacggtaggggttcgggttaggggtaagtttaagggtagggtttacgggtaggtaacgtaccgtacgttaccgtaaacgtttaccggttaccggtttaaccgggaaacggtttccgggggaaaaccccggtttaaacggttccccgttaccggtttacccggtaacggtaccgtaacccgaccccggtaaaccggaaccccctaaaccccggttacgttaccggttacccaaacctttcccgtttacccggtttaaccccccttacccccg

SEQ ID NO: 433742 - DNA, 582 bp, Homo sapiens
  misc_feature: GZ8MTXP02JPXOZ.4.57.F02.1.454.CMB.2.raw
  modified_base (346)..(346): a, c, t, g, unknown or other
  modified_base (354)..(354): a, c, t, g, unknown or other
  modified_base (474)..(474): a, c, t, g, unknown or other
  modified_base (492)..(492): a, c, t, g, unknown or other
  modified_base (494)..(494): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgcttcttttaagaggtgtccagtgtcaggtgcacctggtggaggtcggggggaggcggtggtccagccgtggggggtccctggagactctcctgtgcagcgtctggattcgccttcagtgcctatggcatgccacgtgggtccgccaggcctccgaggcgaaggggctggaagtgggngcagttanagttggttagataggaaactaaacgaaatttcgtaatggacagacctccggtaggaaacggggccgtacttacgacctaactctacccagaacgtaacaaagtttccgaaagtaaccaanatttagaactactagaananagacagtagacgagagacgacggacgacgacgtacgtattattagttagtagagaagtaagtagtagtagtacgttacgttacgttcg

SEQ ID NO: 433743 - DNA, 633 bp, Homo sapiens
  misc_feature: GZ8MTXP02FVXDW.4.57.F02.1.454.CMB.2.raw
  modified_base (315)..(315): a, c, t, g, unknown or other
  modified_base (325)..(325): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccaggcagacggccaggataacctgtgtggaaccagcagtcggaaggtaaaagtgtacagttggtacaggcagaagccaggccaggcccctggtggtggtcgtcgttatgatcgcgaccggcctnagggactccngagcgtattcctcgtcggcctaccaactcggtacggggaccaccgggcccacccgtgacccagtcgacgcgtaggggtccgaaggcccggggtatggacggccgaacttacgttacctgtacgtagggtggtagggtagtaggtagttagggtgtaactctagtaccgttaagtaccgtacgtttacgggaacgttacggggtacccgtaaacgggttccgtacccgttaccgtaccgggtaccaccggaccccgaaacgggtaccccaaaccttcccgaacctttcggtaccctaacgtttcccccg

SEQ ID NO: 433744 - DNA, 673 bp, Homo sapiens
  misc_feature: GZ8MTXP02HFG7Q.4.57.F02.1.454.CMB.2.raw
  modified_base (179)..(179): a, c, t, g, unknown or other
  modified_base (318)..(318): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgcccaccctnagtgtcaggtcggccccgagggcaggccggaccaggactaaccgtggtggtacgggaaccagcagtacggaaggtaaagtgtaacagttggaacaggcaagagccgaggccacggcccctggtggtcggtcgtccgtangagtacggcggaccggccctacgacgggtactcccgtgacgcgtattccctcgtcggcctaccgaacgtcgtacgggaccgaccgggcccacccgtacgacctagcgaggcggtacggggacggaacgggccgggggtatcggggacggtacccgtaacgttaacgttaccgagtcggtagggtaggtaggggtaagttacgggtaggtagggtatacgtacgactcgtaagttaccggttcggttaacggacgttacgggaaccttacgggtcccgtccgtaccgtaccgaccgtaccggaacccgtaacggaccctaaccgtcccgtaacgtccggtacctaccggtttcccg

SEQ ID NO: 433745 - DNA, 761 bp, Homo sapiens
  misc_feature: GZ8MTXP02HGZB9.4.57.F02.1.454.CMB.2.raw
  modified_base (177)..(177): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctnagtgtcagtcggccccagggcagacggccaggactaactggtgtcgggaaccagcagtacgggaaggtaaaagtgtacagttggacaggcaagaacgccgaggccacggcccctggtcggtggtcgtccgttagtgataggccgaccggccctcgagggactcccgtgacgtcgtacttccgtcgtcggacctccgaacgtcgtacggggaccgaccgggaccctacccctaggaacccagtaccgacgaccggtaggggtaccggaaacgggccgggggaatacggggacggacccgtaacgttacgtttaacgtcggttacgtaggggttgggtagggggaatttagggtaggggttaggggttataaacgttccgtaatacccgttaacgttacccggttacgggtttaaaccgggaaaccggtttaccgggggaaaaccccgttaaacgggggttccccgttacccgggtttaaccccgttaccggttacccggtaaaccggtacccccgtaaaacggggacccccttaaaaccgttccccgtaaacggttttcccaaccggtttaacccctttccccgg

SEQ ID NO: 433746 - DNA, 620 bp, Homo sapiens
  misc_feature: GZ8MTXP02FOVVP.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgccaccctcagtgtcagtcggccccgagggcagacggccaggataacctgtgtaggaaccagcagtacggaaggtaaaagtgtactagttggtacaggcaagaacgccgaggccgacggtccccgtggtggtggttcgtccgttatgatacgccggcccggccctcgacgggactcccgtgagtcgtattcccgtcgtcggcctaccgaacgtcgtacgggaccgccggacccacccgtcgaccatcgacgacgagggtacgaacgggccgggatggacggccgtaactagttacgtgtcgtagggtggtaggagttaggtagtgggtagactacgtactcgtaacgttccgtacgttacggaacgtcgggaaccgtaagtcccgtcccgtacgtaccgtacaccgtacccgaacggtccctaaactccacgtcgtacctacgtttacccg

SEQ ID NO: 433747 - DNA, 713 bp, Homo sapiens
  misc_feature: GZ8MTXP02I431S.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcacgtgggtccgccaggctccgaggcaaggggctggaatggggtgctagttatagtggtttgatggaaactaacaaattctatgcagactcgtgaaggccgattcaccatctaccagagactaatttcgaagaacactattacgaatctaacagtatagaacagtctaggaagacggaccgagggaccacggggtcttggttacttaatttagtttggtacgtacggtaaaggtaaggttaaaggttcgggttacctaagtttcggtttaccgttttaggaaccgtagggtcgggggacccgtaacgggggtaacccgttgggtaccgtacccgttcgttcccctacgtacgtcccttaccgaaacccgaacggggtcccctaacgttcccggttacccttcccccggttcggggccccgtccccgttcggtcccgtacccgtaacggggtaccgtaaccccgtaacccggttccggggtaccgggggccctaaccggacgggtccccggtccccggg

SEQ ID NO: 433748 - DNA, 706 bp, Homo sapiens
  misc_feature: GZ8MTXP02ICYGP.4.57.F02.1.454.CMB.2.raw
  modified_base (221)..(221): a, c, t, g, unknown or other
  modified_base (242)..(242): a, c, t, g, unknown or other
  modified_base (302)..(302): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacggccaggatacctgtgtggaacngcatcggaggtaaagtgtacnttgtacaggcagagcaggccagcccgtgtggtgtcgtcgtatgatgcgacccggcctcgngggactccctggagcgtattcgtctcggcctccaacgtcgtacgggaacccaccgggcccaccctacgaaccctactccgaagggccggaacgggggtaccggaaacgggacccgggggtagtacggggacggacccgtaacgtactttaacgtcggtacggtacggggtggtacggggaagttaagggttaggttggggttacggtataccgacgttacccgtaacgtttaccggttacggtttaccgggtaaccggtacgggggtaaccccgtaaaacgggttccccggttacccggtacccgtttaccggtaccaacccggtaaacccgaacccggtaccccgaaacccctccgtaccgtccctaaccgtttcccgttaccggttccccccgtttcccccg

SEQ ID NO: 433749 - DNA, 585 bp, Homo sapiens
  misc_feature: GZ8MTXP02HXT0U.4.57.F02.1.454.CMB.2.raw
  modified_base (364)..(364): a, c, t, g, unknown or other
tcagagcactgtagcacgaccggtgctcgatttagctcgatatagttgggttggggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtgggaaccagcatcggaagtaaaagtgtacattggtacaggcagaagccaggccaggcccctgtggtggtcgtccgttatgataggcgaccggccctcgagggactcccgtgagcgtattcctctggcctccaactcgtacgggaccncggccacccgtcgaccactcacgcgagggtcgaaggccggggatggacggccgattacgtactgtcgaggttgtgggtatagggtagtgggtagaagtcaatcccgtattaccgttcgtacgggaacgtcggggacctaaacgggtcctacccggttacctaccgtaccacggacccgaaacggacccctaaacgtcccaactcggttaccctacttcccg

SEQ ID NO: 433750 - DNA, 630 bp, Homo sapiens
  misc_feature: GZ8MTXP02IECDW.4.57.F02.1.454.CMB.2.raw
  modified_base (218)..(218): a, c, t, g, unknown or other
  modified_base (225)..(225): a, c, t, g, unknown or other
  modified_base (304)..(304): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggcccagggcagacgccaggactaacgtgtgnggaaccngcagtcggaaggtaaaagtgtaacagttaggtacaggcaagaacgccgaggccacggcccctggtggtggtcgtcgttngatagcgaccggcctgacggctcccgtgagcgtattccgtctcggcctccgaacgttcgacggggaccacccgggtccacccgtgaacccagcacgacgagggtacgaacggccgggggatcggacggcccgtaattacgttacgtcggtacgaggggttggtagggtaacgttaggggtaggtgggtaggtactacgtactccgtaagttacgttcgttaacgggaacgtacggggtaaccgtaacggttccgttacccggtaccttaccggaccacgaccccgaacggaccctaactcccaacttcggtcctaaccgtttcccg

SEQ ID NO: 433751 - DNA, 672 bp, Homo sapiens
  misc_feature: GZ8MTXP02I0RM6.4.57.F02.1.454.CMB.2.raw
  modified_base (409)..(409): a, c, t, g, unknown or other
tcagagcactgtagcacgaccggtgctcgatttagctcgatatagttgggtttggggggaagaggaagactgacggtcctcccaggagttcaggtgctgggcaccgtgggcagtggggggaggcgtggtccagccgtggggggtccctgagactctcctgtgcagcgtctggattcgccttcagtgcctatggcatgcacgtcgggtccgccaggcctccgagggcgaagggggctagggaagtggggtgctagttatagttggtttgagtaggaaactaaactaaattctaatgacagacctccggtaggaacggcctatccaccatccaccaagacgaactaagttcgaaagaacactattagaaactactaacaagatacgaaactgtcaggagacgacgaggacncgggtcttagtacttatttagtgtagacgtagtaagtagtggtctagttcggttacgtttagaccggtagggtcgggaccgtaacgggtaccgtggtacctaccgttctacctcgacgtccctaccgaaccgtaccgggtacctacggttccccggttacccttcccccggcgggtcccctcccgtacggtccccgtaccggacggaaccgtcccgtaccggtcggggcccggggaccaaccgggccgggcccggttcccggg

SEQ ID NO: 433752 - DNA, 575 bp, Homo sapiens
  misc_feature: GZ8MTXP02JEX93.4.57.F02.1.454.CMB.2.raw
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggacaggcagaagccaggccaggcccctgtgtggtcgtccgttatgatagcgaccggcccctcaggggactccccgtgagcggactttccgctggctcccaaactctgggacacgggccaccctgacccatcagcagggtcgaagccggggatgacggccgactattacgtgcagggtgtcggggtataggtagttagggtgagtacgacgtaccagtaaccgtcgttacgggaacttagggggaccccaagggttccgtacccgttcccgtacgtccgtaacgacccccgtaaggcccgaaactcccaactcgttcacttccg

SEQ ID NO: 433753 - DNA, 664 bp, Homo sapiens
  misc_feature: GZ8MTXP02HKMIA.4.57.F02.1.454.CMB.2.raw
  modified_base (214)..(214): a, c, t, g, unknown or other
  modified_base (288)..(288): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtggccccagggcagacggcaggataactgtgnggaacagcatcggaaggtaaaagtgtacattggtacaggcagaagcaggccacggccctgtggtgtcgtcgtangatagcgaccgcctgaggactccctgacgcgtattctcgcggctaccaaactctagggaacacggcccacctagaccatcagcgagggtacgaaacggccggggatcggacggacccgtaataacgttactggtacgtagggtgtagggtaagttaaggtaaggtttggagtaacttacaacttaccgaaacgttaccgttacgtttaccggggaaaacgttacggggaaaccgtaaaacgggttcccgttacccggtacccttaacggttacccgaacgggaacccccctaaaacgggaacccccgaaaaaccccccgtattaccggttaccaaacccgtttcccgtttaccgtttaaccccccgtaaacccccc

SEQ ID NO: 433754 - DNA, 734 bp, Homo sapiens
  misc_feature: GZ8MTXP02ITHCQ.4.57.F02.1.454.CMB.2.raw
  modified_base (214)..(214): a, c, t, g, unknown or other
  modified_base (221)..(221): a, c, t, g, unknown or other
  modified_base (299)..(299): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccagggcagacggcaggactactgtgnggaaccngcagtacggaaggtaaagtgtaacagttggtacaggcagaacgcgaggccgaggcccctggtgggtcgtcgtcgttangataggcgacccggcctacggacgggactcccgtaggacgtcgtattctcgtccggcctaccgacgtcgtacgggaacctaccggccctaccgtacggaaccctagtaccgacggacggacggggtaccggaaacggggcccggggtaagtacgggaacggacccgtaacgttacgttacgtacggtacgagggttgggtagggtaagttaagggtagggttaggaggtactaccgtaacgttacccgtaagtttacccggttacggttaaccgggtaaacggtacggggtaaacccgtaacgggtttcccgtaccccgggttacccgtaacggttaccgacccggaaccccggaaaccggtaccccctaaaaccccgtcgttaccggtaccctaacccgtttcccgtttacccggttcccccgtttaacccccg

SEQ ID NO: 433755 - DNA, 368 bp, Homo sapiens
  misc_feature: GZ8MTXP02HKKSZ.4.57.F02.1.454.CMB.2.raw
  modified_base (276)..(276): a, c, t, g, unknown or other
  modified_base (278)..(278): a, c, t, g, unknown or other
  modified_base (280)..(280): a, c, t, g, unknown or other
  modified_base (283)..(283): a, c, t, g, unknown or other
  modified_base (326)..(326): a, c, t, g, unknown or other
  modified_base (363)..(368): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacatggtacaggcagaagcaggcagccccngngngtntcgtatgatagcgacggccctcagggatccctgagcgattccnctggctccaactctgggacacggcaccctgaccatcnnnnnn

SEQ ID NO: 433756 - DNA, 798 bp, Homo sapiens
  misc_feature: GZ8MTXP02IL0NQ.4.57.F02.1.454.CMB.2.raw
  modified_base (221)..(221): a, c, t, g, unknown or other
  modified_base (337)..(337): a, c, t, g, unknown or other
  modified_base (766)..(766): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctcagtgtcagtcggcccagggcagacgcagactactgtgaggaacngacagtacggaaaggtaaaagtcgtaactagttaggtaccgaggcaagaacgccgaggccaggcccctggtggtcggtcgtccgttatgatacgcgacccggcctagacgggtacncccgtgacgcgtacttcccgtcgtcggtcctacctaacgttccgagggaacccgacccgggtacccctaaccccgtacgaacccaacgtaccgaacgggtaccgggtaacgggggtaccggaaacggggacccgggggaagtaccggggaaccggggtaacccggtaaactttaacgttaaccgttggtaccggtaggggtttacggtggggtaaaacgtttagggtaacgggttgggggttacgaaaacgttcctaacgttaacccgtaacggtttaaccggttaccgggttaaaccgggtaaaaccgggtttacggggaaaaccccggttaaacgggttcccccgttaccccggttaaccccgttaacccggaccgtaaacccggaaccccgtaaaaccgggaccctaaaacccgtaacccccggtnttacccggttaacccttacccggtttcccccg

SEQ ID NO: 433757 - DNA, 634 bp, Homo sapiens
  misc_feature: GZ8MTXP02H2W5D.4.57.F02.1.454.CMB.2.raw
  modified_base (306)..(306): a, c, t, g, unknown or other
  modified_base (334)..(334): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggccctcctctctcactgcacaggctctgtgacctcatatgtgctgactcagccaccctcagtgtcagcggcccagggcagacggccaggataacctgtgtaggaaccagcagtacggaaggtaaaagtgtacagttggtacaggcaagaagccgaaggccaggcccctggtggtggtcgtccgttangatagcgaccggccctgaggactcccgngacgcgacttcctcgtcggcctaccgaactcgtacgggaccacgggccaccccgtgaccactcacgcgagggtcgaaacgggccgggggatcggaggtacccgacttaacgtacgtgtcgtaaagggttgggtacgggtaagttaggttacggttgggtagacgttacacgttaccaagttaccggttcgttaacggggaaacgttccggggaaaccgttaaacgggtcctcccggttaacccgttaccgtacgaacgcccgaaacggcccaaaccgtccgtactacgtacctactcccg

SEQ ID NO: 433758 - DNA, 731 bp, Homo sapiens
  misc_feature: GZ8MTXP02HWZQ0.4.57.F02.1.454.CMB.2.raw
  modified_base (666)..(666): a, c, t, g, unknown or other
  modified_base (674)..(674): a, c, t, g, unknown or other
tcagagcactgtagcacgaccggtgctcgatttagctcgatatagttgggtttggggggaagaggaagactgacggtcctcccaggtgtccagtgtcaggtgcacctggtggaggtcggggggaggcgtggtccagccgtggggggtccctgagactctcctgtgcagcgtctggattcgccttcagtgcctatggcatgcacgtgggtccgccaggcctccgaggcgaaggggctagggaatggggtggactagtttatagttggtttagagtaggaaacttaaacaaattctaatcggctaagaccgtccggtaggaacggggcctaattccaacctacttccgtaccaagaacgtaactaatttacgaaagtaaaaccaacgtaatttacggaaattacctaaacgaagtataacggaaaacctaaggtcctaggaacggaacggccccggaaagggaacctaaccggggtccttagttacttaatttagttgtaggacggtaaggtaaggttaaggtgttacgtaagtttcggtttaccttttacggaccgtaggggtacgggggtacccgtaacggggtaacccgttggtaacccacccggttcctcctacgacgtaccctaccgaaccgaacggccctacgttccggtccccttccccgnggtccccncccgtacgtcccaccggaggaaccgtcctacccgtgtacgggcgaccgaacggccgg

SEQ ID NO: 433759 - DNA, 563 bp, Homo sapiens
  misc_feature: GZ8MTXP02FMXZQ.4.57.F02.1.454.CMB.2.raw
  modified_base (338)..(338): a, c, t, g, unknown or other
  modified_base (360)..(360): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacgcaggatacctgtgtggaacagcatcggaggtaaagtgtacattggtacaggcagagccaggccaggcccctgtggtggtcgtccgttatgatagcgaccggccctacgagggactccctgagccggtattcctcgnggctccgaactcgtggggaccnccgggaccaccctgacccagtcagcgagggtcgaaggccgggggatggacggccgtactacgttactgtacgaggtggtgggatagtgtggtgattcatccgtataccgtcgttacggaagtcgggaccgaaacggtccgttacccggtcctaaccggttcacggccccaaagggccccaaactccaactcgtaccacttccg

SEQ ID NO: 433760 - DNA, 535 bp, Homo sapiens
  misc_feature: GZ8MTXP02F79D7.4.57.F02.1.454.CMB.2.raw
  modified_base (327)..(327): a, c, t, g, unknown or other
  modified_base (356)..(356): a, c, t, g, unknown or other
  modified_base (387)..(387): a, c, t, g, unknown or other
  modified_base (422)..(422): a, c, t, g, unknown or other
  modified_base (436)..(436): a, c, t, g, unknown or other
  modified_base (440)..(440): a, c, t, g, unknown or other
  modified_base (450)..(450): a, c, t, g, unknown or other
tcagagcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactcgtgaaggccattcaccatctccagagacaattcgagaacacattagaatctaacagatagaactagtctagagacgaccgaggacacggctgtactattagttgtgngagagtaagtgtcagtcgttctttgacgnggtcgggcgagggaccctgtcaccgtctccncacgcctaccacgacggcccagtccgtcctcccgngccgcctcgctcgngacnccacctcggngggcacgcgccgccgtggctcgcgtcggacgaacggtactaccgtcccagtcgtcgtcgtcgtacggcggcgggcgtacggacgg

SEQ ID NO: 433761 - DNA, 731 bp, Homo sapiens
  misc_feature: GZ8MTXP02I2OY6.4.57.F02.1.454.CMB.2.raw
tcagagcactgtagcacgaccggtgctcgattagctcgatatagttgggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccgccaggctccgaggcgaaggggctagggaagtggggtgctagttatagtggtttgataggaaactaaacaaattctaatgacagacctcggtagaacgggcctattccaacctatcctaccaagaacgtaactaagtttcggaaagaaacctactatttagaaacttacctaacaaggtaactacgaaaactaggttactaggaagacggaccggaggacctacgggtcttagtacttaagtttagttggtagacggtaaaggtaaggttaaaggttggtacgtagtttcggtttaccgttttacggaaccgtaggggttacggggaccgtaacggggtaacccgttcggtacccgtacccgttcctacccgtacgacgtacccgttacccgaaccggaacgggtcccctaacgtccccggtttcccgttacccccggtggtccccgtcccgtacgtcccgtaccgacggtacccgccgtacccggtcgggtacgggggaccaccggaccgggcccggtcccggg

SEQ ID NO: 433762 - DNA, 608 bp, Homo sapiens
  misc_feature: GZ8MTXP02GBA2N.4.57.F02.1.454.CMB.2.raw
  modified_base (149)..(149): a, c, t, g, unknown or other
  modified_base (174)..(174): a, c, t, g, unknown or other
  modified_base (230)..(230): a, c, t, g, unknown or other
  modified_base (313)..(313): a, c, t, g, unknown or other
  modified_base (383)..(383): a, c, t, g, unknown or other
  modified_base (453)..(453): a, c, t, g, unknown or other
  modified_base (486)..(486): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcacgccaccctnagtgtcaggtcggcccagggcaggaccggcaggactaaccgtgtgtacgggaaccngacagtacggaaggtaaaagtgtacagttaggacaggcaaggacgccgaggccacggtcccgtggtcggtggtcgtccgttangatcggccgaccggcctgacggactccgtagacgcgattccgtcgcgtcctaccaactcgtacggaaccnccggcccacctgaaccatcgagcgtaggggacgaacgggccggggataggacggaccgtaatagttacgnggtacgagggtggtacggagttaggtaggtggntaactcgacttcagttacgtcgttacggacgtacgggacctacggtacctccttacgaccgtacgacctacccgacgaccccaaccgactcgtaacccgtttccgtacccgttcccaccccg

SEQ ID NO: 433763 - DNA, 758 bp, Homo sapiens
  misc_feature: GZ8MTXP02JJNBR.4.57.F02.1.454.CMB.2.raw
  modified_base (235)..(235): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggcccaggcagacgcaggataactgtgtagacagcagtcggagtaaagngtacatggacaggcagaagccaggccacggcccctggtggtcggtcgtcgttatgatacgcgacccggcctacgaggtactcccgtgacgcggtattcccgtcgtcggtcctacctaacgtccgtacggggaccgacccggaccctaccccgtacgaacccacgtacgacggaccggtacggggtacccggaaacggggcccgggggaagttacggggaacgggtacccgtaaacgttaacgtttaccggtgtacggtaaggggtcgggttaagggggtaagttagggtagggtttacgggtagtaaacgttccgtaaccgttaaccgtaacgttaacccggtttaccggttaaccggggtaaaaccggttacggggtaaaaccccggttaacgggtttaccccggttacccggttaaccccgtttaaccggacccgttaaacccgggaacccccggtaaacggacccccgtaaaaccctacccgtaaccgtttaccggtacccttaacccttttacccccgg

SEQ ID NO: 433764 - DNA, 604 bp, Homo sapiens
  misc_feature: GZ8MTXP02F5ZWX.4.57.F02.1.454.CMB.2.raw
  modified_base (287)..(287): a, c, t, g, unknown or other
  modified_base (315)..(315): a, c, t, g, unknown or other
  modified_base (350)..(350): a, c, t, g, unknown or other
  modified_base (362)..(362): a, c, t, g, unknown or other
  modified_base (371)..(371): a, c, t, g, unknown or other
  modified_base (387)..(387): a, c, t, g, unknown or other
  modified_base (542)..(542): a, c, t, g, unknown or other
  modified_base (553)..(553): a, c, t, g, unknown or other
  modified_base (559)..(559): a, c, t, g, unknown or other
  modified_base (590)..(590): a, c, t, g, unknown or other
tcagagcactgtagcacgaccggtgctcgatttagctcgatatagttggggtttggggggaagaggaagactgacggtcctcccaggagttcaggtgctgggcaccgtgggcagtgggggaggcgtggtccagccgtggggggtccctgagactctcctgtgcagcgtctggattcgccttcagtgcctatggcatgcacgtgggtccgccaggctaccgaggcgaaggggctaggaagtggggtgctagttatagttggtttagataggaactaacaaattctatnacagactcgtagaggcctatcaccatcncgagacactaattcgaagaacatatagaatactanagtatacgaacngtacagganacggcgaggcacggtntcgtattattatgtgagagagtaagtgtactagtcggtttctttaggacgtaggtcgggaccgtaacgggaaccgttcgggtacaccgttcgtaccctacgacggttaccctacggaaaccgacgggtccctaacgtccggttcccttccccggngccccggtacncgtccncgaggacgcctaaccggtcggaccggggtanacggcgcccggtcg

SEQ ID NO: 433765 - DNA, 611 bp, Homo sapiens
  misc_feature: GZ8MTXP02I4J2N.4.57.F02.1.454.CMB.2.raw
  modified_base (298)..(298): a, c, t, g, unknown or other
  modified_base (372)..(372): a, c, t, g, unknown or other
  modified_base (507)..(507): a, c, t, g, unknown or other
  modified_base (563)..(563): a, c, t, g, unknown or other
tcagagcactgtagcacgaccggtgctcgatttagctcgatataggttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggcaggactaactgtgaggaacagcagtcggaaggtaaaagtgtacagttggacaggcagagccaggccaggcccctggtggtagtcgtcgttangatacggcgaccggccctgaggactcccgtgacgcgtattccctcgtcggcctaccaacgtccgtacgggaccncgggacccacccgtgaacctaagtcgacgacggacggggtaccgaacgggaccgggggtatcgggaacggccggtaactttaacgtacgtcggtacgtaggggtagggtagggtaagttagggtaggtcgggtanaacgtcacgtcacgttacgtccgtaggacgtacggaccgtaggtccgtccgtaccncgtaccgcgtaacccgaaggcccaactcccgacgtcgactaccttccg

SEQ ID NO: 433766 - DNA, 718 bp, Homo sapiens
  misc_feature: GZ8MTXP02H3MZA.4.57.F02.1.454.CMB.2.raw
  modified_base (216)..(216): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggcccagggcagacgccaggataactgtgnggacagcagtacggaaggtaaagtgtacagttggtacaggcagaagccagccaggcccctggtggtggtcgtccgttatgatagcgaccgcctcgacggactccctgacgcgacttcctcgtggctacactcgtcgggacgacggccctaccctacgacctactacgacggacgacggggtacggaacgggccgggggagtacggaacgggacccggtaacttacgttaacgttcggtacggtacgggttaggtagggggtaagtttagggtaagggttggggttaccggtaaattccgaacgttaccgtaaacggtttaacccggttaacgtttaccggggtaaaacccggttcgggggtaaaacccggttaaacgggttaaccccgttcccggtttaacccgttaaccgggttacccgtacccggtaaccccggaaaaccggacccccggtaaaactttacccccgacgtacccggtttacctaaacccggtttcccccg

SEQ ID NO: 433767 - DNA, 622 bp, Homo sapiens
  misc_feature: GZ8MTXP02FMKV3.4.57.F02.1.454.CMB.2.raw
  modified_base (513)..(513): a, c, t, g, unknown or other
  modified_base (601)..(601): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctgggtggaggtcggggggaggcggtggtccaggccgtggggggtccctgagactctcctgtgcagcgtcgtggattcgccttgagtcgcctagtggcatcgcacgtcgggtcccgcgacggcctacccgaggcggaacggggtcgtgggaacgtggggtgacgtaggtttagtagttgggtttagagtaggtaaactaaacgtaaattctaatgtacacgtaccgtcggtaggaacgggtccgtattcccactactcctacgagacgtaactaagttcgaaagaccataattagaaactcgtaacagtaanacgaaagtacgtcgtagaaggacggacgaaacggacgaccggtgttacgtctaatttagtcgagagaaggtaacgttaaggcggttanacgttcgtttacgtttacggg

SEQ ID NO: 433768 - DNA, 699 bp, Homo sapiens
  misc_feature: GZ8MTXP02JDONV.4.57.F02.1.454.CMB.2.raw
  modified_base (316)..(316): a, c, t, g, unknown or other
  modified_base (334)..(334): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcaggtcggccccgagggcaggaccggcaggactaacctgtggtaagaaccagacagtacggaaggtaaagtgtaactagttggtaacaggcaagaacgccgaggccacggcccctggtggtggtcgtcgttangatacgccgaccggtccngaggtctcccgtgacgcgtactcccgtctcggacctaccgtaacgtcggacgggaaccgaccggaccccacccgttacgaccctacgttccgaacggaccggtaacggggtaccggaaacggggtcccgggggaataccggggacggtaccccgtaacgtttacgttacgtcggtacgaaaggggttggtaggggtaagttaggttagggtggtagtaacgtacgtactacccgtaacgtttaccggtcgttaacgggaaccgtacggggtaacccgtaaacggttcccgtaccgttacccggtacgtacccgacgaccccgtaaggaccctaactacccgacgtacgtacctacgtttaccccg

SEQ ID NO: 433769 - DNA, 649 bp, Homo sapiens
  misc_feature: GZ8MTXP02JCKQL.4.57.F02.1.454.CMB.2.raw
  modified_base (179)..(179): a, c, t, g, unknown or other
  modified_base (227)..(227): a, c, t, g, unknown or other
  modified_base (234)..(234): a, c, t, g, unknown or other
  modified_base (311)..(311): a, c, t, g, unknown or other
  modified_base (347)..(347): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtcgacctcatatgtgctgactcacgccaccctnagtgtcaggtcggccccgagggcagacggccaggactaaccgtggtgnggaaccngcagtcggaaggtaaagtgtaacagttggtacaggcagaagccaggccgacggcccctaggtggtggtccgtcgttntagagtacgccggaccggcctacgaagggctcccgngacgcgtacttcctcgtcgctaccgacgtcgtacgggacctccggcccaccgtacgaccacgtacgacgacgtagggtaccgaacgggccgggggtatgggaccggccgtaacttacgttacgacgtacggtagggtgggtaagggtagtttagggtagggttggtacgtactacgactaccgtaacgttacggttaccgtacgggaaccttcggggaaaccctaaggtccttcccggtacctcgtaccgaccgacccgaacggacccctaacctaccgtacgtacctcgttaaccttcccg

SEQ ID NO: 433770 - DNA, 548 bp, Homo sapiens
  misc_feature: GZ8MTXP02I31TZ.4.57.F02.1.454.CMB.2.raw
  modified_base (281)..(281): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcactgggtccgccaggctccaggcaaggggctggaatggggtgcagttatagtggtttgatggaactaacaattctatgcagactcgngaaggccgatcaccatctccagagactaagtttcgaagaacactattagaaactctaacagatagaacagtctagagacgccgaggacacggtctgttctattagttgtgcgagagtaagtgtcagtgttctttgacgtagtcgggccgacggtacctcggtcaccgtctcctcgatcttccgaccgacggccacgtcgtccttcccgtcgccgcctcgcgtaccgacgacgccgaccgtcgtacgggggctacgcgccggtcccgg

SEQ ID NO: 433771 - DNA, 703 bp, Homo sapiens
  misc_feature: GZ8MTXP02F0EBQ.4.57.F02.1.454.CMB.2.raw
  modified_base (294)..(294): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggcaggataacctgtgtggaaccagcagtcggaaggtaaaagtgtaacagttggtacaggcagagccaggccaggcccctgtggtggtcgtcgttangatagcgaccggcctcgagggactcccgtggagcgtattcgtcgtcggcctacccgaacttccgacggggaaaccacccggggccccaaacccccgtggaacccaacgtccgaacggacggacggggtaccgaaacgggcccgggggaatagggaacgggcccgtaaacgttaacgttaccgtaggttaccgaggggttggtagggggtaagttaggttaggtggttagattacgactcgtagtacggtttacgttaccggaacgttcggggaacctaaacggttcccgttacccggttacccttaaacggtccgaaccggtacccccgaaacggggacccccctaaacccccgtacgttaccggtaccctaacccgttccttaccccgtttacccccgttaacccccg

SEQ ID NO: 433772 - DNA, 705 bp, Homo sapiens
  misc_feature: GZ8MTXP02JX9R1.4.57.F02.1.454.CMB.2.raw
  modified_base (692)..(692): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcagtcggaaggtaaagtgtacattggtacaggcagaagccaggccaggcccctgtggtggtcgtcgttatgatagccgaccggccctcgagggactcccgtgacgcgtattccctcgtggcctaccaacgtcgtagggaccaccgggcccacccgtgaccctagtccgacgcgaggggtaccggaacgggcccgggggatacgggacgggacccgtaacgttaagtttaaccgtcggttccgaagggggttgggtagggggtagttaagggtagggttgggtagacgttacgacttacccgtacgttaccggttcgtttaacccgggtaaaccggttacgggggaaacccgttaaacgggttccccgttaccccgggttaccttaacccggtaccgtaaacccggacccccggtaaaaccgggacccctaaaacccgtttcccaaaccgttccggttaaacccnccttttacccccg

SEQ ID NO: 433773 - DNA, 739 bp, Homo sapiens
  misc_feature: GZ8MTXP02H8169.4.57.F02.1.454.CMB.2.raw
  modified_base (217)..(217): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccacctcagtgtcagtcggcccagggcagacgcagataactgtgtggaacngcagtacggaaggtaaagtgtacagttggtacaggcagaacgccaggccaggcccctggtggtggtcgtcgttatgatagccggaccggcctcgagggactcccgtggacgcgtacttctcgtcggcctaccgaacgtcgtacggggaaaccacccgggccccaccccgttacggaaccctagtaccgacggacgaacggggtaccggaaacgggcccgggggtagtacgggaccgggcccgtaacgttacgttacgtcggtacggtaggggttaggtaggggtaagttagggttagggttagggtagtacgttacgtactaccgtaacgttaccggttacggtttaccgggaaaccgtttccgggggaaaacccgttaacggggtttaccccgtttaccccggttaccgttaaacccggtaccggtaacccgtacccccgaaacgggaacccccaaacccccggtacttacccggtaccctaacccgttccctttaccccggtttaacccccttacccccc

SEQ ID NO: 433774 - DNA, 640 bp, Homo sapiens
  misc_feature: GZ8MTXP02FRVZ0.4.57.F02.1.454.CMB.2.raw
  modified_base (153)..(153): a, c, t, g, unknown or other
  modified_base (178)..(178): a, c, t, g, unknown or other
  modified_base (289)..(289): a, c, t, g, unknown or other
  modified_base (317)..(317): a, c, t, g, unknown or other
  modified_base (328)..(328): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcagcccaccctnagtgtcagtcggcccgaggcagacggccaggactaacctgtgtaggaaccagcagtcggaagtaaagtgtacagttggaacaggcaagacgccgacggccacggccctggnggtggtcgtcgtatgatcgcgaccgccngaggctcccgngacgcgtacttcctcgtcggacctaccgtaacgtccggtacgggaccgccggtaccctaacccgcgaccctagtaccgaggcgtacggggaacggaacggcgggggtatacggggacgaccgtattaagttccgagtacgtagggttggagggtaagtagttagggtgggtatacgtacgaacttacgtaacggttaccgacgtttaaccggggaactacggggacccgtaaagttccccgttacgtacccgtacgtaccgaccgaacccgaacggaccctaacctcgaccgttacgtacctacccgttccg

SEQ ID NO: 433775 - DNA, 699 bp, Homo sapiens
  misc_feature: GZ8MTXP02GRJ05.4.57.F02.1.454.CMB.2.raw
  modified_base (228)..(228): a, c, t, g, unknown or other
  modified_base (304)..(304): a, c, t, g, unknown or other
  modified_base (370)..(370): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccngcagtcggaaggtaaaagtgtaacagttggacaggcaagaagccgaggccacggcccctggtggtggtcgtcgtangatagcgaccggcctgagggctcccgtgagcgtattccgtcgtggctaccaactcgtaggggaccncgggcccaacccgtgacccaatcgacgacgacgggtccgaaagggcccggggagtacggacgggcccgaaattaacgttaccgtggtacgtaagggggttggtagggggtaattagggttaagggttgggggtacgtaaacttccgaaatttacccgaacgtttaaccgtcccggtttaaacgggaacccgttacgggggaaaccctaaagggggttccccttacccggttacccgttaaaccggtacccgaaccggtaacccccgaaaacggggacccccaaaaccggttaccccctaacgttacggtaccctaacccgtttccccgg

SEQ ID NO: 433776 - DNA, 549 bp, Homo sapiens
  misc_feature: GZ8MTXP02JXBRF.4.57.F02.1.454.CMB.2.raw
  modified_base (187)..(187): a, c, t, g, unknown or other
  modified_base (226)..(226): a, c, t, g, unknown or other
  modified_base (284)..(284): a, c, t, g, unknown or other
  modified_base (293)..(293): a, c, t, g, unknown or other
  modified_base (309)..(309): a, c, t, g, unknown or other
  modified_base (360)..(360): a, c, t, g, unknown or other
  modified_base (364)..(364): a, c, t, g, unknown or other
  modified_base (369)..(369): a, c, t, g, unknown or other
  modified_base (371)..(371): a, c, t, g, unknown or other
  modified_base (396)..(396): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtnccccagggcagacggccaggataacctgtgtgggaaccngcatcggaggtaaatgtacatgtacaggcagagccaggccaggcccctgtggtggtcnccgttatgntagcgaaccggccctnagggatcccctagcgcgattcctctgcctccactctggggacacggtcccncccncgacncncagacgacggtacggacggacgggngagacgacgtactattctagtacgaggtaggttagggtagtagttaggtaggtgtactacactactactacgttacgtacgtaacgtacggacgacgtacgtccgtactacgtacgacgaccgaaccgaccaacctacctactactactactc

SEQ ID NO: 433777 - DNA, 701 bp, Homo sapiens
  misc_feature: GZ8MTXP02FUUAC.4.57.F02.1.454.CMB.2.raw
  modified_base (318)..(318): a, c, t, g, unknown or other
  modified_base (329)..(329): a, c, t, g, unknown or other
  modified_base (348)..(348): a, c, t, g, unknown or other
tcagagcactgtagcacgaccggtgctcgatttagctcgatatagttgggtttggggggaagaggaagactgacggtcctcccaggagttcaggtgctgggcaccgtgggcatggggggaggcgtggtccagcctggggggtccctgagactctcctgtgcagcgtctggattcgccttcagtgcctatggcatgcacgtgggtccgccaggctccaggcaaggggctaggaagtggggtgctagttatattggtttgataggaactaacaaattctatgacagactccggtagaacgggccatccaccatctcaganactattcgaanaacactattgaactctaanagtataccgaacagttcagagacgaccggaggacacggtcttagtacttatttagttgtagacgaagagtaagtggtcgtagtcggttcttttacgacgtagggtacggggaccgaaccgggtaaacccgttcggtaccgtaaccccgttccgttacccgtaccgaccgttacccgtttaccccgaaacccggtaaaccgggtcccccgttaaacgtttccccggttcccccgtttccccccggtaccgggtccccgtaccccgttacgtcccgttaacccgacgggtaaccgtcccgtacccggtcccgggttacgggggacccaaaccgggaccggcccggttaccccggg

SEQ ID NO: 433778 - DNA, 792 bp, Homo sapiens
  misc_feature: GZ8MTXP02II1OR.4.57.F02.1.454.CMB.2.raw
  modified_base (306)..(306): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtagggaaccagcagtacggaaggtaaaagtgtacattggtacaggcaagaagccgaggccacggcccctgtggtggtcgtccgttangatagcgaccggccctcgagggactcccgtagacgcgattcccgtcgtcggctaccgaacttccgtacggggaaccctacgggacccctaccccgtacgaaccctagtaccgaacggaccgaacgggggtaccggaaacggggacccgggggaactacggggaacgggtacccggtaaacgttaacgttaaccgttagggttaccgtaaagggggttacgggttagggggtaaacgtttaagggttaagggttaggggtacgtaagttaccgtaacgttacccgtaaacgtttaaccggttccgttaaaccggggtaaaaccggtttacgggggaaaaccccgttaaacgggggttaccccttacccggggttaaccccgttaaaccggttacccgtaaaccggtacccccgtaaaacggggtaacccctaaaacccgttaccccgtaaacgtttaccgttaacccgtaaccgttttaacccccgg

SEQ ID NO: 433779 - DNA, 638 bp, Homo sapiens
  misc_feature: GZ8MTXP02I5TMK.4.57.F02.1.454.CMB.2.raw
  modified_base (301)..(301): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccacctcagtgtcagtcgccccagggcaggacgcaggataacgtgtgtcggaaccagcagtacggaaggtaaaagtgtaactagttggacaggcagagcaggccacggccctgtggtcggtcgtcgttaangacgtagccggaccggcctcgagggactcccgtagacggacgtagttccctacgtcggtacctaccgaacgttaccggtacggggaccgacccggcccctacccgttacgaccctagccgacggaccgtacgggggtagaaccggggaccgggggattcgggacggtacccggactttaagttaccgtagtccggtaagggttgggtagggacggttaagtgggtagggtatacgtcagtcctaaatcggttacgacgtacgtcgggactaacggtcctaccgtacctacgccacgtaccgaacgtcccaaacgttccactcgttaccactttcccg

SEQ ID NO: 433780 - DNA, 656 bp, Homo sapiens
  misc_feature: GZ8MTXP02JYFCD.4.57.F02.1.454.CMB.2.raw
  modified_base (153)..(153): a, c, t, g, unknown or other
  modified_base (271)..(271): a, c, t, g, unknown or other
  modified_base (520)..(520): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcacgccaccctcagtgtcaggtcggccccgagggcagacggcaggactaaccgtgtgagggaaccagcagtacggaaggtaaagtgtactagttggtaacgaggngaagacgccaggccacggccctgtcggtggtcgtcgttatgatacggcgccggcctacgaggtactccgtgacgcgtattcccgtcgtagtcctaccgtaacgttcggacgggaccacccggacccaccgtcgaaccgtagaccgacggaccggtagggtaccggaacggggcgggggactacgggacggaccgtacgttaattcgcgtacgaggggttaggtagggtagtaaggttcggttagggtanacgttacgtacgtacctaacgttaccggttacgttacgggtaaaccgtcggggtaaccgaacggttcccgtacgtacccttacggaccaccgacccgaaacggacccttacgacctacgtcgtaccgaccttcccg

SEQ ID NO: 433781 - DNA, 688 bp, Homo sapiens
  misc_feature: GZ8MTXP02GSKQ9.4.57.F02.1.454.CMB.2.raw
  modified_base (479)..(479): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgcttcttttaagaggtgtccagtgtcaggtgcaccgtgggtggaggtcggggggaggcggtggtccaggccgtgggggtccctgagactctcctgtgcagcgtctggattcgtccttcagtcgcctagtggcagtgacctacgtcgggcccgccgaggcctccgaggcggaaggggcgtaggagtggggtgctagttattacgttgttagagtaggtaacttaaataattctagtcgacgtagtaccgtccggtaggaacgggtcctacttaccaacctatcccaacgtagactaacttagttaccgaaanaactactagttaacgattacctagtaacgtaagaacgtaaacgtacggtcgtaaacggacgggaaccggaccgggaacggggtaccgtaaccgggttcgttaggtttaacttaacgtttttacggtacgggtaccgtaaggggtaaaggttaacggggttaaggtttcggtacgttaacggtttccgggtttttacgtttaacccgggg

SEQ ID NO: 433782 - DNA, 695 bp, Homo sapiens
  misc_feature: GZ8MTXP02GE5JC.4.57.F02.1.454.CMB.2.raw
  modified_base (226)..(226): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcgacctcctctctcactgcacaggctctgtgacctcatatgtgctgactcagcccaccctcagtgtcagtcggccccagggcagacgccaggataactgtgtggaaccngcagtcggaagtaaagtgtacagttggtacaggcaaggaacgcgacggccacggcccctggtggtgtcgtcgtatgatagccgaccggcctgagggactcccgtaggacgcgtattcccgtcgtcggtcctacctaactcgtacggggaccaccgggcccctaccgtacgacccatacgaggacggaggggtaccggaagggcccggggatacgggacggacccgtaattacgttacgtacgtcgtaggggtggtagggtaagtaggttagggtagggttacaacgtctaacgtacccgtagtttacccggtacgttaaaccggggtaacgtacgggggtaaaacccgtaacgggtcccgtttaccccggttaccgttaaccggtaccgtaaaccggaacccccgaaaacgggtaccccctaaaaccctttcccgaaccgtttaccggtaccctaaccgtttcccccgg

SEQ ID NO: 433783 - DNA, 632 bp, Homo sapiens
  misc_feature: GZ8MTXP02FQBBA.4.57.F02.1.454.CMB.2.raw
  modified_base (260)..(260): a, c, t, g, unknown or other
  modified_base (316)..(316): a, c, t, g, unknown or other
  modified_base (321)..(321): a, c, t, g, unknown or other
  modified_base (350)..(350): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagccgtggggggtccctgagactctcctgtgcagcgtctggattcgccttcagtgcctatggcatgcacgtgggtccgccaggctccgaggcgaaggggctggaagtggggtgctagttatagttggtttnagtaggaaactaaacaaattctatgacagactccgtagaacgggcattcaccatcncaganactattcgaagaacacattagaatctaanagatacgaaactgtcgtagacgacgaccggagaccgacggtcttagtacttagtttagtgtagacgagtagtaaggtgtactagtcggtttctttagaccgtaggtcggggaccgtaacgggaacccgtggtacctacccggttctcctcgacgtccgttaccccaacggtaaccgggcccctacggttcccggttccccttcccccggtcgggcccgtccccgtcgcccgtaccgacggtacgcccgtacgtcgggacggggccaacgcggccggtcccgg

SEQ ID NO: 433784 - DNA, 628 bp, Homo sapiens
  misc_feature: GZ8MTXP02GL9XW.4.57.F02.1.454.CMB.2.raw
  modified_base (309)..(309): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggacggccaggataaccgtgtggtcgggaaccagcagtcggaaggtaaaagtgtaacattggaacaggcgagaagccaggccacggcccctggtggtggtcgtccgttangataggccgaccgccctcgagggactccccgtgagtcgtattccctacgtcggctaccaacgtcgtacgggaaccgccggacccaccttcgaacctatacgacgacgaggggtaccgaaacgggccgggggaatgggacggctaacgttagttacgcgtcgtagggtggtagggatagggttagcgggtatacgtactagtaccctagttacgtaccgtttacggaaacgtcggggaacccgtaagggtccttacccggtactaaccggtcacgacccgtaaggccctaaacgtcccaacgtcgtacctacgtttcccg

SEQ ID NO: 433785 - DNA, 598 bp, Homo sapiens
  misc_feature: GZ8MTXP02I67WO.4.57.F02.1.454.CMB.2.raw
  modified_base (225)..(225): a, c, t, g, unknown or other
  modified_base (298)..(298): a, c, t, g, unknown or other
  modified_base (460)..(460): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcaggtcggccccagggcagaccggcaggataacctgtgtggaaccngcagtcggaaggtaaagtgtaacattggtacaggcagagccaggccacggcccctgtggtggtcgtccgttangatagcgacccggcctgacgggctcccgtgacgcgtatctctcgcctcaactcgtggaaccacgccacctcgacactcgagcgagggtacgaggccggggatagggacgtccgaattacgttacgtgtacgagggttgtagggtaattaggtaggtgggtanagtacactacgtaacgttcgttacgttacggaacgtacgggaacctaacgggtccttcccgttaccgtaacgtaccgaccgtaacccgaccggacccaaccctacgtctaccacctttccgtccttacccctaccccg

SEQ ID NO: 433786 - DNA, 600 bp, Homo sapiens
  misc_feature: GZ8MTXP02FLSQJ.4.57.F02.1.454.CMB.2.raw
  modified_base (228)..(228): a, c, t, g, unknown or other
  modified_base (285)..(285): a, c, t, g, unknown or other
  modified_base (370)..(370): a, c, t, g, unknown or other
  modified_base (390)..(390): a, c, t, g, unknown or other
  modified_base (476)..(476): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccngcatcggaaggtaaaagtgtaacagttggtacaggcagaagccgagccacggccccngtggtggtcgtcgtatgatacgcgaccggcctcgagggactccctgagtcgattccctcgtcggctaccgactcgtacgggaccncggcccaccgtacgacctanccgagacgtagggtaccgaacggccggggatcgggacgccgaactattacgtgtcgaagggtgtaggggactagtaggttagggtnacgtacataccgtatacgttcgtacgaacgtcggaccgtaacggtccgtacccgtaccgttacgaccgaccgacccgaaacggacccctaaaacccgtccgtacgtccgtacctaccgttcccg

SEQ ID NO: 433787 - DNA, 672 bp, Homo sapiens
  misc_feature: GZ8MTXP02IAOA7.4.57.F02.1.454.CMB.2.raw
  modified_base (270)..(270): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggctccaggcaaggggctgggaagtgggtggcagttatagttggtttgataggaaactaanaaattctatgcagactccggtaggaacggccgattcaccatcctccagacgactaatttcgaagaacactattgaaatactacagatagaaactgtactagagacgccggaggacacgggcttcgtacttagtttacgttgtaggcgtaaggtaggtaaggttggtctacgttcggtttccgttttaggaaccgtaggggtcggggtaccgtaaccggggtaaacccgttcgggttacccgtaccggttcctcccgtacgtaccgtccctttacccgaaccggtaaaccgggcccctacgttcccggttccccttcccccggtcggtccccggtcccgttcggccctaccgacggtacgaacccgtaccgtcggtcgggggacaccggcggcccggtcccgg

SEQ ID NO: 433788 - DNA, 699 bp, Homo sapiens
  misc_feature: GZ8MTXP02GYCV3.4.57.F02.1.454.CMB.2.raw
  modified_base (298)..(298): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacgccaggataacctgtgtgggaaccagcagtacggaaggtaaagtgtacagttggtacaggcagaacgccaggccacggcccgtggtggtggtcgtcgttangatacgccgaccggcctcgagggacctcccgtagacgcgtattcgtcgtcggcctaccgaacgttccggtacgggaaaccctacccgggccccctaacccgtcgaaaccctacgtaccgaacggccggaacgggggtaccgaacggggtcccgggggagtacggggaccggacccgtaacgttacgtacgtggtacgtagggttgggtacggggtattagggttaggttgggtatatacgacgttaccgtaagttaccgttacggttacggaacggtacgggaaccgtaacggttcccgttacccgtaccgtacggtaccgaccggtaaccccgaaccggtaccccaaaccccgtcgttaccgtactacccgttcccgttccccgttacccccgttccccc

SEQ ID NO: 433789 - DNA, 678 bp, Homo sapiens
  misc_feature: GZ8MTXP02FLLRS.4.57.F02.1.454.CMB.2.raw
tcagagcactgtagcacgaccggtgctcgatttagctcgatatagttggggtttggggctgggcctaaggaagcagcactggtggtgcctcagccatggcctggaccgttctcctcctcggcctcctctctcactgcacaggctctgtgacctcatatgtgctgactcagcccacctcagtgtcagtcggccccgagggcagacgccaggataacctgtgtgggaaccagcagtcggaagtaaaagtgtacattggtacaggcagaagcaggccaggcccctgtggtggtcgtcgtatgatacgcgaccggccctcgacgggactcccgtgagacgtattcctcgtggcctaccaaacgttcgacgggaaccgaccgggccctaaccctacgaaccctacgtaccaaggcgaacgggggtaccggaaacgggccgggggaatacgggaacgggacccggtaacttaaacgttaacctagggtaccgaaggggttacggtagggggtaagtagggtaaggttggggtaggtaaacttcgaaacttaccgtaagttaccggtacggtttaacggggaacgtttacggggaaaaccgtaaacggttaccgttcccgttaccgtacgtaccgacgacccgaaacgggcccaacgtcccaaacgttcggtactacctacccgg

SEQ ID NO: 433790 - DNA, 712 bp, Homo sapiens
  misc_feature: GZ8MTXP02F1E1Y.4.57.F02.1.454.CMB.2.raw
  modified_base (226)..(226): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggatacctgtgtggaaccngcagtcggaaggtaaagtgtacagttggtacaggcagagcgaggccacggcccctgtggtggtcgtcgtatgatacggcgaccggcctagagggactcccgtgagcgtattcccgtcgtcggacctaccgtaacgtccggttaacggggacctaccgggacccctaccgtacgaccactacgagaccgaggggtaccgaacgggtaccggggatcgggacgcccgtaattacgttacgtcgtacggtaggggttaggtaggggtaagttagggttagggtacggggttacgaacttaccgtacggttacctaaacggtttccggttaccggtttacggggtaaaaccgtttacgggggaaaccccgtaaacgggggtttcccctacccgggttaccgttaaccggttaccgaacccgttaaccccgaaaacgggacccccttaaaactaccccgtaccgttcggtaacccgtacccgttttccccg

SEQ ID NO: 433791 - DNA, 623 bp, Homo sapiens
  misc_feature: GZ8MTXP02F6Y23.4.57.F02.1.454.CMB.2.raw
  modified_base (153)..(153): a, c, t, g, unknown or other
  modified_base (227)..(227): a, c, t, g, unknown or other
  modified_base (299)..(299): a, c, t, g, unknown or other
  modified_base (374)..(374): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcacgcccaccctcagtgtcagtcggccccgagggcaggacgcaggatacgtgtgaggaacngcagtcggaaggtaaagtgtacagttggacaggcagagccgaggccacggccctggtggtggtcgtcgttangatacgccgaccggccctagacggactcccgtgacgcgtattcccgtctcggcctaccaacgtccgtagggaccnccggcccaccgtcgaccatcgacgacgacgggtacggacgggacggggagtacggacggaccgtacgtacgttacgtcgtacggtagggtagggtagggtaggtaggttaggttagggtagtacgtacgtactacgtacgttacgttacgtacggtacggtacggtacgtaccggtccgtaccgttaccgacgtttttaccgaccgtaccgaaccgaccacctacctacgtacgtacctacgtttcccg

SEQ ID NO: 433792 - DNA, 559 bp, Homo sapiens
  misc_feature: GZ8MTXP02F0RF5.4.57.F02.1.454.CMB.2.raw
  modified_base (205)..(205): a, c, t, g, unknown or other
  modified_base (209)..(209): a, c, t, g, unknown or other
  modified_base (215)..(215): a, c, t, g, unknown or other
  modified_base (265)..(265): a, c, t, g, unknown or other
  modified_base (279)..(279): a, c, t, g, unknown or other
  modified_base (282)..(282): a, c, t, g, unknown or other
  modified_base (362)..(362): a, c, t, g, unknown or other
  modified_base (391)..(391): a, c, t, g, unknown or other
  modified_base (415)..(415): a, c, t, g, unknown or other
  modified_base (501)..(501): a, c, t, g, unknown or other
  modified_base (536)..(536): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccaggcagacgcagatacngtgnggaacngcagtcggaagtaaagtgtacatcggtacagcagagccaggccaggcccngtggtgtcgtcgtngangcgaccggcctcgaggactccgtgagcgtattcgtctacggtcctaccaaattcgacgggaaccacggcccacctgaccntcagcgacgggtacgaaggcccggggtanacggacggccgtaactatttacgngtgtagggtgtaggggatagggtacgtgggactatacgactaccgtagtcgttaccgtacggaacgtcggggaactaacgggtccnccgtcctaggcacgacccgaacgacccaacccgtntacactctctacctaccctaccg

SEQ ID NO: 433793 - DNA, 612 bp, Homo sapiens
  misc_feature: GZ8MTXP02FUSDS.4.57.F02.1.454.CMB.2.raw
  modified_base (345)..(345): a, c, t, g, unknown or other
  modified_base (368)..(368): a, c, t, g, unknown or other
  modified_base (380)..(380): a, c, t, g, unknown or other
  modified_base (389)..(389): a, c, t, g, unknown or other
  modified_base (416)..(416): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggactaaccgtgtggtagggaaccaggcagtacgggaaggtaaaagtgtaactattggtacaggcagaagccgagggccaggcccctgtggtggtcgtcgtatgatagcgaccgcctgaggactccgtgagcgattctcgnggcctaccactcgtgggaaaccncgggccaacccngaaccctanacagacgacgggacgaaggccgggganacggacgccgtaactacgttacgtgtacgtagggtgtagggtagtaggtagtgtactatactactacctaagttaccgtacgttacgggaacgtcgggaaccgtacggtcgttacccgtaccgtacgaccgaccgacccgaaaccgaccccaaacccgtcgtacgtacctaccttccgtaccgttaccccctaccc

SEQ ID NO: 433794 - DNA, 955 bp, Homo sapiens
  misc_feature: GZ8MTXP02HJR8T.4.57.F02.1.454.CMB.2.raw
  modified_base (149)..(149): a, c, t, g, unknown or other
  modified_base (237)..(237): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctnatatgtgctgactcacgcccaccctgagtgtcaggtccggccccgagggcaggaccggccaaggaataaccgtgtggtacgggaaccngacaggtacggaaggttaaagtgtacagttaggaacaggacgaagacgaccgacggcccacggccccgtggtcgggtacggtcggttaccgtttagaggtacgtacggcccggaacccggtcccctacggacgggtaccctcccgtaggacgtccggtatttccgtcgtccccggtaccctacccgtaacgttaccggtaacggggaaaccccgtaccgggaccccccgtaacccgtacgaaacccccgacgttacccggaacgggaaccggggtaaacccgggggtaaccgggaaaccgggggttaccccgggggaagttaccgggggaaacccgggtacccccggttaaagtttaccggtttaacgttacggggttaccgggtaagggggttggggttaaaggggtaagtttaggggttaacggggtttggggtaacgtaacgttacccgtaacgtttaaccccggttaaaggtttaccccggtttacggggttaaacccgggttaaccgggggttaaccggggaaaaccccgtttaaccggggttccccgtttaccccggttaaacccgtttaacccggtaccggtaacccccgggtaaacccccggaaaacccgggtaccccccctaaaaaccccgttcgtttaacccgggttacccccttaaaccctttcccccgggttttacccccgtttacccccccgtttaaaccccccg

SEQ ID NO: 433795 - DNA, 645 bp, Homo sapiens
  misc_feature: GZ8MTXP02JUBHS.4.57.F02.1.454.CMB.2.raw
  modified_base (226)..(226): a, c, t, g, unknown or other
  modified_base (630)..(630): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcaggacggccaggataacctgtgtgggaaccngcagtacggaaggtaaaagtgtaactagttggtaacaggcaagaacgccgaaggcccacggcccctggtcgggtcggtcgttccgttatgagtacgcgacccggcctcgaggactccctggacgcgtatctcgtcgcctccaactcgtaggggaaccctaccgggcccctacccgtgacctatccgacggacgacgggggtaccgaaacggggcccgggggtaatcgggacgggccgtaacgttagttacgtaggtcgtagggttggtaggggaagttaggtggttagggtagcgttaccatccgtattaccggtcttaacgggaacgtcgggaaccgttaacggtccttccgtaccgtacgtacgaccgacccgacgaccctaacccgattcgacctcgtccnccggtttccccaccc

SEQ ID NO: 433796 - DNA, 665 bp, Homo sapiens
  misc_feature: GZ8MTXP02JWWU1.4.57.F02.1.454.CMB.2.raw
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggccccagggcagacggccaggataacctgtgtggaaccagcagtcggaaggtaaaagtgtacagttggacaggcaagagccgaggccgacggcccccgtaggtggtcggtccgtccgttatgaagtacgccggacccggccctacggagggtactcccgtgacgcgtattcgtcgtcggcctaccaacgtcgtgggaaaccgcggcccacccgtagacccatcgacgtcgaggggtaccgaaacgggcccggggtaatacggggacggtacccgtacgtacgttacgtacggtacgtagggtggttaggggattaaagggtggtacgggtagagtacacgtaccagttaccggttcttacgggaacgtcgggtaactaacggttaccgtccggttcccgttaccgccgacccgacccgaaaccggcccccaaaaccccgcgttaccgtaccctaccttcccgtacccgttcccctccccc

SEQ ID NO: 433797 - DNA, 743 bp, Homo sapiens
  misc_feature: GZ8MTXP02HA85T.4.57.F02.1.454.CMB.2.raw
tcagagcactgtagcacgaccggtgctcgatttagctcgatatagttgggtttggggggaagaggaagactgacggtcctcccaggagttcaggtgctgggcaccgtgggcatgggggaggcgtggtccagcctgggggtccctgagactctcctgtgcagcgtctggattcgccttcagtgcctatggcatgcacgtgggtccgccaggcctccgaggcgaagggggctggaagtggggtgctagttatagttggtttagataggaaactaaactaaaattctaatgcaagacctccggtaggaacgggccgtaattccaacctattcctaccgaagaacgaacctaaagtttacggaaagtaaaccaactaagtttagaaacttcctaaacaagtatacgaaacctagttcaggaagacggaccggaggaaccgacggcttagtacttatttagttggtgacgtaaggtaagtaggtggtactagttcggttcctttaggaccgtagggtcggggaccgacgggtaaccctgggtacctacccgttctcccgtacgacgtacccgttacccgaaccggtaaccggggtacccctaacgttccccggtttaccccgtttccccccggtgggtcccccgtccccgttcggtaccccgttaaccccggaacgggtcccgaacccgtaacccggtttccggggtaccgggggaccacccggtaccgggccccgggtcccccgggg

SEQ ID NO: 433798 - DNA, 720 bp, Homo sapiens
  misc_feature: GZ8MTXP02JI9CQ.4.57.F02.1.454.CMB.2.raw
  modified_base (480)..(480): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcaggacggccaggataacctgtgtgggaaccagcagtcggaaggtaaaagtgtacagttggtacaggcaagaagccaggccacggcccctgtggtggtcgtccgttatgatagcgaccggcctcgagggactccccgtgacgcggtacttcccgtcgtcggtcctacccaacgtccgttacggggaccaccgggccccacccgttcgaaccctatccgaggtaccgaggggtaccgaaacggggcccgggggatcgggacggacccggtattactttaccggnggtacggtagggttcggtaggggtaagtttagggtacggttgggtagtacttaccgtaacgttaccgtaacgtttacccggttaccggttaaccggggtaaccggttaaccggggtaaacccgttaaccggggtttcccgttaccccggttaccgttacccggtacccgtaccggaacccccggaaacggtacccctaaacccgttcccgtaacgtttacccgttacctaccgtttcccg

SEQ ID NO: 433799 - DNA, 676 bp, Homo sapiens
  misc_feature: GZ8MTXP02GBC10.4.57.F02.1.454.CMB.2.raw
  modified_base (225)..(225): a, c, t, g, unknown or other
  modified_base (258)..(258): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggcccagggcagacggccaggactaacctggtgtaggaaccngcagtcggaaggtaaagtgtactagttggtacnggcagaacgcgaggccacggccccgtggtggtcggtcgtccgttatgatagccgacccggcctcgagggactcccgtgacggcgtattcgtcgtcggtcctaccgaacttcgtacgggaacccaccgggtcccacccgttcgaaccctactccgacgcgtacggggtaccgaacgggcccggggagtacggacggtccgaacttacgttacgtcgtacgtagggttcggtaggtagtaggtaggtggtatagtcacgttccgagttacgttacgttacgggaacgttacgggggaacctaacgggttcccttaccgggttacctttaccggaccaccggtacccccgaaacggccccctaaacccgtaaccgttcgtaacccgtactttcccgttaccccggttccccgtttcccccg

SEQ ID NO: 433800 - DNA, 725 bp, Homo sapiens
  misc_feature: GZ8MTXP02FYHBW.4.57.F02.1.454.CMB.2.raw
  modified_base (173)..(173): a, c, t, g, unknown or other
  modified_base (217)..(217): a, c, t, g, unknown or other
  modified_base (298)..(298): a, c, t, g, unknown or other
  modified_base (317)..(317): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcagtcgcccaggcagcgcaggactaactgtgacggaacngcaagtcggaaggtaaagtgtactagttggtacaggacagacgccgacggccgacggccctggttggtcggtcgtcgttangagtacgccgacccggccncgacggactcccgtagacgtctactcgttcgtacccggcctaccgaaacgtcggtaacggggaacccgtaccgggacccaacccgtacgacctacgtacgaacggtacgggacggggtacggaaacggggcccgggggaatacggggacggtacccgtaacgtacgtttaacgcggtacgtaaggggttgggtagggttaagggttaaaggttggtgggtattacgtacgttaaccgtccgttaattacccgggttacgttaaccggtaacgggtacgggtaaacccgtacggtttcccgtaccgttacccgttaaccgtacggacccgaaacccgaaaccccggtaacccgaaaccccgtacgttaccggtaccttaccgttcccttaccctcccccgtttaacccc

SEQ ID NO: 433801 - DNA, 650 bp, Homo sapiens
  misc_feature: GZ8MTXP02GZT2I.4.57.F02.1.454.CMB.2.raw
  modified_base (328)..(328): a, c, t, g, unknown or other
tcagagcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaacggcattcacatctccagagactaattcgagaacacattagaatactacaagatagaacagtctagagacgaccggagacgacggctgtcttattattgtgngaggtagtaaggtgtctagttcggttccttttaggaccgtggggtcggggaccgaaccggggtaaaccccgttgggtacctacccgttcctacccgtcgtaaccgtcccttacccgaacccgtaacggggcccctacggtcccgttaccccgttcccccgtcggcccgtccccgtcgccctccgacgggaccgaccgtacccgtcgggtcgggggacaccggacggcccggtccgtcgggtaccgtcggtaccgtaggtaccgaacggtaccttaccgtaccctacgtacgtcgcgtcgtacggcgtccgggcgacggaacg

SEQ ID NO: 433802 - DNA, 687 bp, Homo sapiens
  misc_feature: GZ8MTXP02JWAVH.4.57.F02.1.454.CMB.2.raw
  modified_base (381)..(381): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtcccgccaggctccaggcgaaggggctgggaagtggggtggcagttatagtggtttgataggaactaactaaaattctatgacagtacctccggtaggaacgggccgtattccaaccatcctaccgaagacgaactaagtttacgaagaaacactattagaatactacagtatacgaanagtctaggagacggaccgagggaccgaacggtcttagtacttaatttacgttggtacgacggtaaggtaaggttaaaggtcgggtactaagtttcgggttccttttaggacccgtaggggttaccggggaaccggtacggggtaaccccgttcgggtaccctacccgggtcttacccgtccgaacgtcccttacccgacgtaaccggccctacgtcccggttccctccccgcggacccgtcccgtcgtacctccggacggctaaccgtacccgtcgggcggggaccaccggtcggccggtacccgg

SEQ ID NO: 433803 - DNA, 557 bp, Homo sapiens
  misc_feature: GZ8MTXP02GR1ZC.4.57.F02.1.454.CMB.2.raw
  modified_base (291)..(291): a, c, t, g, unknown or other
  modified_base (317)..(317): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccaggcagacgccaggataactgtgtggaaccagcatcggaaggtaaaatgtacattggtacaggcagaagccaggcagcccctgtggtggtctccgttangatagcgaccgcctcgaggactccgngagcgtattcctcgtgcctacaactcgtagggacaccggaccaccctgaaccatcagacgaggtacgaaggcgggataggacgccgataactactgtcgagggtgtagggatagtaggtcggtagactcaactccgtaattaccgtacgttacggaacgtcgggaaccgtaggtcctccgtacgtaaccgtacaacggacccgaaacgtacccaaaacctccgtacgtcgtactactacg

SEQ ID NO: 433804 - DNA, 775 bp, Homo sapiens
  misc_feature: GZ8MTXP02F58U9.4.57.F02.1.454.CMB.2.raw
  modified_base (323)..(323): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagcccaccctcagtgtcagtcggccccagggcaggacggccaggactaaccgtggtggtagggaaccagcagtacgggaaggtaaaagtcgtactagttggtacaggcaagaacgccgaggccacggccccgtaggtcggtcggtccgtcgttagngtataggccggaacccggtccctacggacgggtacttccccgtaggaacgtcgtactttcccgtccgtcggtacctacccgaaaccgttccggttacggggaaccgccgggaccctacccgtacgacccataccggacgacggtacggggaccgtaacggggccggggaatcgggaacgggcccgtaaacgttacgttacgtacggtacgtaaggggttgggtaagggtaagttaggggttaggtaggggtacgtaaacgttccgaacttaccgtaacggttaccggtaccgtttaacggggaaacccggtacgggggtaaaaccccgttagggttacccccgtttacccggttaacccgttaaccgtacccgaacccggtaaccccgaaaccgggtacccgttaaaaccctacccggttaaaccttccggtaacgttacccctttccccgg

SEQ ID NO: 433805 - DNA, 677 bp, Homo sapiens
  misc_feature: GZ8MTXP02JQFCJ.4.57.F02.1.454.CMB.2.raw
  modified_base (173)..(173): a, c, t, g, unknown or other
  modified_base (210)..(210): a, c, t, g, unknown or other
  modified_base (214)..(214): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctnagtgtcagtcggcccagggcagacgccaggataaccngtgnggacagcagtcggaagtaaagtgtacagttggacaggacagacgccaggccacggccctggtcggtggtcgtcgtatgatacgcgaccggcctcgaggactcccgtggacgcgtactttcgtctccggcctaccgtaaacgtcgttacggggaaaccacccggggtccccaaccccgtgaaacccgacgttaccgaacggccgtaaacgggggtaccgaaacgggcccgggggtaatacggggaaccggtacccgtaacgttaacgttaccgttaggtaccgagggttgggtagggtaagttaggttaagggtgggtagtacgtaccgtaactcccgtagtttaaccggttccgttaaccgggaacgttacgggaacccgtaacggttccgtacccgttaccgtaccgtacgacgaccccgtaacgacccaaccgtacgtcgactcgtcctccgtccctcccc

SEQ ID NO: 433806 - DNA, 645 bp, Homo sapiens
  misc_feature: GZ8MTXP02I4IJ2.4.57.F02.1.454.CMB.2.raw
  modified_base (427)..(427): a, c, t, g, unknown or other
  modified_base (466)..(466): a, c, t, g, unknown or other
  modified_base (490)..(490): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcggcccgaggcagacggcaggataacgtgtagtgggaaccagcagtcggaaggtaaaagtgtaacagttcggaacaggcaagacgccgaggaccacggtccccgtggtcgggtcggtacgttacgttagtgacacggtccgaaccggtccctacggagggactcccgagacgtcgtactcccgtcgtcgtacctccgtaatccggtacgggaccgtacccggcccaccccgtcgaacccganccgaacgacggtacgggggtaccgaacgggcggggtacngggacgacccgtaattacttacgngtcgagggttggtagggtattagggttacggtgagtactcgactaccgtagtaccgtagttacggaagtcggaacgtacggttccgtaacccgttcgtaaccgtccgacgaacccgtaaccgaccctaatacccgaattcggacctactttcccg

SEQ ID NO: 433807 - DNA, 780 bp, Homo sapiens
  misc_feature: GZ8MTXP02GWQ27.4.57.F02.1.454.CMB.2.raw
  modified_base (213)..(213): a, c, t, g, unknown or other
tcagagcactgtagcacgaccggtgctcgatttagctcgatatagttgggtttggggggaagaggaagactgacggtcctcccaggtgtccagtgtcaggtgcacctggtggaggtcgggggggaggcgtggtccagccgtggggggtccctgagactctcctgtgcagcgtctggattcgccttcagtgcctatggcatgcacgtgggtccncaggcctccgaggcgaaggggctagggaagtggggtggctagttatagttggtttgagtaggaaactaaacgtaaattctaatcgacaagtaccgtccggtaggaacggggcctattccaactactcctccgaaggacgtaacctaagtttacgaagtaaacactattagaaatctaaacgagaatacgaaacacgttacgaggaaggaccggaccgggaagggaaccgtaccggggtcttacggttaacttaaagttttacgttaggtaggacggtaaggtaaagggttaaggttaggttacgtaagtttcggtttaccgttttacggaaacccggtaggggttaccgggggaccggtaaaccggggtaaccccgttcgggtacccgttacccggttccctaccgtacgaccgtaccgttacccgaacccggaacgggtcccctaaccggttcccggttacccccgttccccggtaccgggtcccgtaccccgtcgtacccgtaccgacggtaaccgacccgtaccggttccgggacggggaccctaaccggggccgtccccgggg

SEQ ID NO: 433808 - DNA, 668 bp, Homo sapiens
  misc_feature: GZ8MTXP02FVCCZ.4.57.F02.1.454.CMB.2.raw
  modified_base (221)..(221): a, c, t, g, unknown or other
  modified_base (302)..(302): a, c, t, g, unknown or other
  modified_base (449)..(449): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcccaccctcagtgtcagtcggcccaggcagacggccaggatactgtgtaggaaccngcagtcggaaggtaaaagtgtaactagttggtaacaggacagaagccgaggccacggcccctggtggtcgtcgtccgttangatcgcgaccggccctgaggactcccgtggacgcgtattccgtcgtacggtccctaccgaacgtccgtacgggaaacccgccgtccccgaacccttggaacccacttcgaaccggcgaacggggttacgaaaccgggccggggtaancggaacggtacccgtaacgtacgtttacgtcgttacgaggtaggttaggggtaataggggttaagttgggtatacgtactaacgtccgaagttaccgttctacggggttaacgacgggtaaccgtaacggtcccttaaccgttcccgtacgttccgacgaccccgacggtaaccccaacccgtacgtacgtccgaccttacgtccgttacccctacccg

SEQ ID NO: 433809 - DNA, 601 bp, Homo sapiens
  misc_feature: GZ8MTXP02GJ93Y.4.57.F02.1.454.CMB.2.raw
  modified_base (325)..(325): a, c, t, g, unknown or other
  modified_base (367)..(367): a, c, t, g, unknown or other
  modified_base (391)..(391): a, c, t, g, unknown or other
  modified_base (419)..(419): a, c, t, g, unknown or other
tcagagcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcacgtgggtccgccaggcctccgaggcgaagggggctagggaatggggtgctagttatagtggtttgataggaaactaacaaattctaatgcagacctccggtagaacggccattccaccatcctccaganactaatttcgaagaacactattagaatctacagtatagaacngtctagagacgacgaggacacggntgtactattatgagcgagagtagtggtntagtcgttctttcgacgtaggtcggggacaacgggaaccctggtccgaccgtccgtcctcgacgtccttaccaaccgaccggaccctacgtccggtcccttcccccgtggccccgtccgtcgtcctacccgagaccgccgtacccgtcggtacgggggcctaaccggcggacccggtcccgg

SEQ ID NO: 433810 - DNA, 674 bp, Homo sapiens
  misc_feature: GZ8MTXP02I69E7.4.57.F02.1.454.CMB.2.raw
  modified_base (278)..(278): a, c, t, g, unknown or other
  modified_base (294)..(294): a, c, t, g, unknown or other
  modified_base (458)..(458): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatcggaggtaaaagtgtacattggtacaggcagagccaggccaggcccctgnggtggtcgtccgttangatagcgaccggcctgaggactccctgagcgtattctcgtcggcctaccgaactcgtaggggaaaccaccgggcccaccctacgaacccactacgagacgagggtacgaacggccggggtagcggaggaccgactacgtacgtgtcgaggtgagggttttttanaggttaggtggtgtagtacgactaccgtacgttaccgttacgttaccgggtaaacgtacggggtaaaccggtaaacgggttacccgttacccggttacccgttaaccggttaccgtaaccggaccccgtaaaccgggaacccccaaacccccgtaacccgttaccggttacccgtaccctttacccgttacccggtttacccccggttcccccccg

SEQ ID NO: 433811 - DNA, 745 bp, Homo sapiens
  misc_feature: GZ8MTXP02IBDY8.4.57.F02.1.454.CMB.2.raw
  modified_base (214)..(214): a, c, t, g, unknown or other
  modified_base (220)..(220): a, c, t, g, unknown or other
  modified_base (264)..(264): a, c, t, g, unknown or other
  modified_base (272)..(272): a, c, t, g, unknown or other
  modified_base (286)..(286): a, c, t, g, unknown or other
  modified_base (303)..(303): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtcgcccaggcagacggcaggataactgtgnggaacngcagtcggaagtaaagtgtacatggtacaggcagagccaggccngcccctgnggtgtcgtccgttngatagcgaccggccctnagggatccctgagccgattccctacgtggctccaactcgtacgggaccgacgggacccacccgtcgaaccctatcgagccgaagggggtacaaacgggcccgggggaatcggggaacgggaccccggtaagttaaacgttaccgttacggtccggtaaagggttggggttaggggtaaaggtttaacgggttaaaggggttggggttaccgtaaggtttaccgaaattacccccggtaaagtttaacccgggttaccgttttacccgggggaaaacccgttcgggggttaaaaccccgtaaaaccgggggttacccctttccccggggtacccttttaaaccccggggttaacccgtaaccggacccccggtaaaacgggggtacccaaaaacccgtcccccttaaaaccgtccggtttacccgtaaacccctttaccccgg

SEQ ID NO: 433812 - DNA, 537 bp, Homo sapiens
  misc_feature: GZ8MTXP02IQLZ4.4.57.F02.1.454.CMB.2.raw
  modified_base (177)..(177): a, c, t, g, unknown or other
  modified_base (329)..(329): a, c, t, g, unknown or other
  modified_base (338)..(338): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctnagtgtcaggtggccccagggcagacggccaggataacctgtgtgggaaccagcatcgggaaggtaaagtgtacattggtacaggcagaagcaggccaggcccctgtggtggtcgtcgttatgatagcgaccggccctcgagggatcccgtgngcgattccnctggctccaactctaggacgacgcccacccgtgacccatcagcgtagggcgaaggccggggatggacgccgtactagtacgtgtacgaggtgtgggataggtaggtggtgatcatcagtacgtcgtacggacgttcgggacaaggtcgtaccgtactaccgtcgacgcccgaacgcaacctccacgtcgtaccactccg

SEQ ID NO: 433813 - DNA, 687 bp, Homo sapiens
  misc_feature: GZ8MTXP02I74TG.4.57.F02.1.454.CMB.2.raw
  modified_base (180)..(180): a, c, t, g, unknown or other
  modified_base (282)..(282): a, c, t, g, unknown or other
  modified_base (385)..(385): a, c, t, g, unknown or other
  modified_base (556)..(556): a, c, t, g, unknown or other
tcagagcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagnggtgtccagtgtcaggtgcacctggtggaggtcggggggagcggtggtccaggtcccggtggggggtaccctggacgtactctccgtgtgcagcgtcgtggnttccgccttcagtcgcctatggcatgactacggtcggcccgcgagccgtacccgaggacggtaacggggtctaggggaagttggggtacggcctaaaggtttntaacggtttggggttttagaacggttaacggtaaaaccttaaacgtaaaattcctaaagtcgaccgagtaccgtacgtagggaaccgggacctatctaaccatacctaccgagtaacgaacctaacgttagaacgtaacaacgtactttacgaaacttacgacaaagttanaaaccggtaagacgtacgaacggacgaacggaccgaagtaccgacgtattacggtacgtttaagttacgtacggtaacgaagtaaacggtaagttacggtacggtactttacgtttccggttaccttacgg

SEQ ID NO: 433814 - DNA, 670 bp, Homo sapiens
  misc_feature: GZ8MTXP02JZ4A2.4.57.F02.1.454.CMB.2.raw
  modified_base (153)..(153): a, c, t, g, unknown or other
  modified_base (177)..(177): a, c, t, g, unknown or other
  modified_base (232)..(232): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctnatatgtgctgactcagccaccctnagtgtcaggtcggccccagggcagacggccaggactaaccgtggtgtgggaaccngcaagtcggaagtaaagtgtacattggtacaggcagaacgccaggccgacggcccctggtggtcggtcgtccgttatgatacggccggaccggtcccctacgagggtactcccgtaggagcgtattcccgtacgtcggtcctaccgaacgttcgtacggggaaccgacccgggtaccctaccccgttaggaaccctataccgacgggacgtacgggggtaccggaacgggggtaccgggggagtacggacggggtacccgtaacgttaacgttacgtcggtaccgtaggggtaggttaggggagttaggtacggtgggtacgataccgtagtacccgtaagttaccgtcgttacgggaacgtcgggaccgtacggtcctacccgtcgtacgcgtacgacccgtaaggaccctactccgtactacgtcctacgttcccg

SEQ ID NO: 433815 - DNA, 721 bp, Homo sapiens
  misc_feature: GZ8MTXP02HD8HY.4.57.F02.1.454.CMB.2.raw
  modified_base (325)..(325): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcacgccaccctcagtgtcaggtcggccccgagggcaggacggccaggactaacctggtgtacggaacagctagtcggaaggtaaagtcgtactagttcggtacaggcgaagaacgccgacggccacggtccccgtggtcggtacggttccgtccgttanacgtagtaggccggacccggtcctacgacggggtacctccccgtaggacgcgttacgttcccttaccgtcggtacctacccgtacttccggtaacggggaccgacccgggtaccccacccgtcgaaccctagaccgacggacggtacgggtaccggaagggtacccgggggatcgggaacggacccgtacgttaacgttacgtcggtacgtaggggtggttacgggtagtttaagggtgggtagggtacgtagtcgtaactaccgtacgttaccggttacgttacgggaaaccggttacggggaaccgttaaacggttccgtacccggtaccgtacgtaccgacgacccgtaacggacctaaacccgtcctaacgtccgtacctaaccgtttcccg

SEQ ID NO: 433816 - DNA, 638 bp, Homo sapiens
  misc_feature: GZ8MTXP02GQAGX.4.57.F02.1.454.CMB.2.raw
  modified_base (175)..(175): a, c, t, g, unknown or other
  modified_base (211)..(211): a, c, t, g, unknown or other
  modified_base (218)..(218): a, c, t, g, unknown or other
  modified_base (237)..(237): a, c, t, g, unknown or other
  modified_base (290)..(290): a, c, t, g, unknown or other
  modified_base (328)..(328): a, c, t, g, unknown or other
  modified_base (355)..(355): a, c, t, g, unknown or other
  modified_base (482)..(482): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcacgcccaccctnagtgtcagtcggcccaggcagacgcagactacgtgngaggacngcagtacggaagtaaagtntacagttggacaggcagacgccgaggcccacggccgtgtggtcgtcgtacgtngtagtacgccgaccgcctagacggtactccgtgcgctntctcgtccgctcgactcggacggaccnccggccctaccgagacctacacggacgtacgggtacgggacgacgggtccggggatacggggacggtacctacttacgttacgtggtaacggtggggtaggtagggtaagtttaaggtggttagggntaacgtactaccgtaacgtcggttaacgtcggttaaccgggaaacggtcggaaaacccttggttccccttaccggtacccttaggaccccaccggaacccgaaccgtcccccaaaccgtctaccgtacctccttccggtaccctaccccttccccg

SEQ ID NO: 433817 - DNA, 597 bp, Homo sapiens
  misc_feature: GZ8MTXP02FULIN.4.57.F02.1.454.CMB.2.raw
  modified_base (333)..(333): a, c, t, g, unknown or other
  modified_base (373)..(373): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtcggccccagggcagacggccaggataacctgtgtgggaaccagcatacggaaggtaaaagtgtacagttggtacaggcagaagccgaggccaggcccctggtggtggtcgtccgttatgatagcgaccggccctgagggactcccgngagcgtattccctcgtcggctaccaactcgtacgggaccncggcccacctgaccatcagcgaggggtacgagggacccggggatcgggacggcccgaactagttaccgtgtcgtaggggtggtagggaagttagtaggtagggtagatcgactcgtagtaccgtcgttaccggaacgttacggggaacctagggttccctacccggtacctaccggtcaacgcccgaaacggccaaacctcgaactcgtacccacgtttacccg

SEQ ID NO: 433818 - DNA, 680 bp, Homo sapiens
  misc_feature: GZ8MTXP02JFTB4.4.57.F02.1.454.CMB.2.raw
  modified_base (276)..(276): a, c, t, g, unknown or other
  modified_base (432)..(432): a, c, t, g, unknown or other
  modified_base (456)..(456): a, c, t, g, unknown or other
  modified_base (554)..(554): a, c, t, g, unknown or other
  modified_base (670)..(670): a, c, t, g, unknown or other
tcagagcactgtagcacgaccggtgctcgatttagctcgatataggttgggttggggctgggcctaaggaagcagcactggtggtgcctcagccatggcctggaccgttctcctcctcggcctcctctctcactgcacaggctctgtgacctcatatgtgctgactcagccaccctcagtgtcaggtcgccccagggcaggacggtccagggacttaaccgtgtggtacggaacctagctaagtcgggaaaggttaaagtgtacagtttggaacgnggcctagaacgtccgaggccgaacggccccttggtcgggttcggtcgttccgttaggtgaatacggccggtacccgccctacggtacggacctccccgttgaacggtccgtactttccccgtcgtcggtccctaccgtacgttccgacggggaccnccgggacccaccctcgaacctacncgacggcgaagggtaccgaaacgggcggggtaactgggacggacccgtaacgtagttacgcgtcgaaggggtttgaggggtaagttgtacgggttagngtacgctacttaccggattccggtacggttaccgagtaccggtaaaactcgggttaccgtacccgttccgtacgacccgacgtaccgaaccgtctacctaccgttacgacttaccncgtttccccg

SEQ ID NO: 433819 - DNA, 794 bp, Homo sapiens
  misc_feature: GZ8MTXP02GLK4P.4.57.F02.1.454.CMB.2.raw
  modified_base (242)..(242): a, c, t, g, unknown or other
  modified_base (275)..(275): a, c, t, g, unknown or other
  modified_base (287)..(287): a, c, t, g, unknown or other
tcagagcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcaggtggccccagggcagacggccaggataacctgtgtgggaaccagcatcggagtaaangtacatggacaggcagagcagccaggcccctgnggtgcgtcgtangagtagcgaccggcctcgagggactccccgtgacgcgtaacgttcctcgtacggacctacccgtaaacgttacccgtaggggaaccaccggggtaccccctaaacccccgttcgggaaaccctaacgtttacccgaaacgggtcccgtaaacgggggttacccggaaaaacgggggccccgggggttaagacgggggaaaccgggtacccccggtaaacgttaaacggtttacccgtaggttaccggtaaacgggggtttcgggtaaagggggttaacctttaacgggggtaacggtttacgggggtttaggaaaacccttggtaaacggtttcccccgaaaaggttacccggttacggttttaacccgggggaaacgttaacgggggtaaacccgttaaaagggtccccgttaccgggtacccttaccgttacggacccggttaaccccgaaacgtaccccgtaaaacgttcccccaaaacgttcggtaacctacctttacccggg

SEQ ID NO: 433820 - DNA, 765 bp, Homo sapiens
  misc_feature: GZ8MTXP02F26AU.4.57.F02.1.454.CMB.2.raw
  modified_base (218)..(218): a, c, t, g, unknown or other
tcagagcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccacctcagtgtcagtcggcccagggcaggacggcaggatactgtgtggaacngcatacggaagtaaaagtgtaacagttgggtaacaggggacaaggaacgcccggacgacggacccgtccgtggtcgggtcgtccgtttatagtagtacgtacggacccggcccgtccgtaacggggacggtccccttcggaaggacgtaactcgttcgtacggtccctaccctaaccgtacgtacggggaacgaaccggtacccgaccccgtacgaactaaaccgacgaacggcggaaacgggtcgggaaaaccgggccgggggaactggaaccgggtacgaacccgtttattaaacgttcggaggtaaggggttgggtagggtaaaggttaagttacgggggttaaggcccggtaaattaccggttaaacttaccccgggtaaagttacccggttacgtttaaaccgggtacgggtaaccgggaccgtaaaacgggtccccgttccccgttacgtaaacccgttaacgacgaaccccgaaaccggcccgtaaaacccccaacgttcgtacctacccgtcttacccgttaaccccctaccctacccg

SEQ ID NO: 433821 - DNA, 527 bp, Homo sapiens
  misc_feature: GZ8MTXP01BHX3R.51.12.B01.1.454.CMB.2.raw
  modified_base (270)..(270): a, c, t, g, unknown or other
  modified_base (381)..(381): a, c, t, g, unknown or other
  modified_base (387)..(387): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtcncctgcaagacctctggctacaccttcagtgcaacaacgtccacgtgggtgcgccaggcccctggacaagggccttgagtggatgggaatggttgctgagactggtgccganaaattntgcacgaggaggtttcggggcagggtcatcgagtcggaccggggacacgtccatccgccaacacttacatggaactgaccagtctgactagtttcgacgacacgggccttactaattacgtgtgcgacaaggaaggcggg

SEQ ID NO: 433822 - DNA, 520 bp, Homo sapiens
  misc_feature: GZ8MTXP01ACV83.51.12.B01.1.454.CMB.2.raw
  modified_base (270)..(270): a, c, t, g, unknown or other
  modified_base (281)..(281): a, c, t, g, unknown or other
  modified_base (294)..(294): a, c, t, g, unknown or other
  modified_base (315)..(315): a, c, t, g, unknown or other
  modified_base (383)..(383): a, c, t, g, unknown or other
  modified_base (466)..(466): a, c, t, g, unknown or other
  modified_base (470)..(470): a, c, t, g, unknown or other
  modified_base (493)..(493): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagagcccggggctcagtgaggtcnctgcaagcctntggctacaccttnagtgcaacacgtcactgggtncgccaggcccctggacagggcttggagtggatgggaattgggtttaagctgagtactgggtcgccganaaattatgcacgaggtaggtttcggggcagggtcatcagtcggaccggggacacgtcatcgccacaactacatggactgaccngtcngacattgacgtacacggccgttntaattactgtcgcgacaagaaggcggg

SEQ ID NO: 433823 - DNA, 497 bp, Homo sapiens
  misc_feature: GZ8MTXP01AP7A1.51.12.B01.1.454.CMB.2.raw
  modified_base (236)..(236): a, c, t, g, unknown or other
  modified_base (414)..(414): a, c, t, g, unknown or other
  modified_base (433)..(433): a, c, t, g, unknown or other
  modified_base (455)..(455): a, c, t, g, unknown or other
  modified_base (462)..(462): a, c, t, g, unknown or other
tcagcgatcgtatacacgaccggtgctcgatttagtagtgtagattccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagcggcaggccctgtgtggtgatgtataaagacactgagaggccctgagggatccctgagcgattctcctggctccgaggtcaagggacaacggtcacattggccatcagtgagtccaggcagaggacgaggctgacttattatgtacaatcaacngacacattgtacttatgtntcgaactgcacaggtcacgtcngggttcncgcccaacgccaacccgctgttcaacttcgtcccg

SEQ ID NO: 433824 - DNA, 528 bp, Homo sapiens
  misc_feature: GZ8MTXP01ETJ20.51.12.B01.1.454.CMB.2.raw
  modified_base (270)..(270): a, c, t, g, unknown or other
  modified_base (283)..(283): a, c, t, g, unknown or other
  modified_base (316)..(316): a, c, t, g, unknown or other
  modified_base (383)..(383): a, c, t, g, unknown or other
  modified_base (472)..(472): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtcncctgcaagacctntggctacaccttcagtgcaacacgtcatgggtncgccaggcccctggacaagggccttggagtggatggggaattgggtttgctgagactgggtgccganaaattatgcacgagggtaggtttcggggctaggggtcagtcagtgaccggggacacgtccatccgccacaacttacatggaactgaccngtctgactatttgacgtacacggccgttactaattactgtgcgacgaagaagcggg

SEQ ID NO: 433825 - DNA, 533 bp, Homo sapiens
  misc_feature: GZ8MTXP01AW29B.51.12.B01.1.454.CMB.2.raw
  modified_base (267)..(267): a, c, t, g, unknown or other
  modified_base (287)..(287): a, c, t, g, unknown or other
  modified_base (309)..(309): a, c, t, g, unknown or other
  modified_base (369)..(369): a, c, t, g, unknown or other
  modified_base (398)..(398): a, c, t, g, unknown or other
  modified_base (468)..(468): a, c, t, g, unknown or other
  modified_base (491)..(491): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccgggctcagtgagtcnctgcagctctgctacacttnagtggcaacacgtcacgtggtncgccaggcccctggacaggccttgagtgatgggaatggtttgctgagactggtcgccganaaattgtgcacgagggtaggtttcggggntagggtcagtcagtgaccggggacacggtccagtccgaccaacgtaacttacgacgtcggaactcgaccngtctagactatttcggacgtacncggccgttctaattacgtgtcgcgacgtaacgaacggccggg

SEQ ID NO: 433826 - DNA, 575 bp, Homo sapiens
  misc_feature: GZ8MTXP01D8L02.51.12.B01.1.454.CMB.2.raw
  modified_base (273)..(273): a, c, t, g, unknown or other
  modified_base (409)..(409): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagacgcccggggctcagtgaaggtcncctgcaagacctctggcctacaccttcagtcggacaacaacgtccacgtgggtgccgccaggccccctggacaagggccttggagtggatgggaattgggtttaagctggagtaacgtgggtcgaccgataaattntgacacgagggtaggtttacgggggcgtagggtcagtcgagtaggacccggggacacggtccatccgaccacgaacttacacgtggaactcgaccagtcctgactagtttcgaacgtacgaccggttccgttactaattacgtgtcgcgaacgtaagaacgccggg

SEQ ID NO: 433827 - DNA, 565 bp, Homo sapiens
  misc_feature: GZ8MTXP01CAUA9.51.12.B01.1.454.CMB.2.raw
  modified_base (237)..(237): a, c, t, g, unknown or other
  modified_base (421)..(421): a, c, t, g, unknown or other
  modified_base (432)..(432): a, c, t, g, unknown or other
tcagcgatcgtatacacgaccggtgctcgatttagtagtgtagattcggcgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcacctgctctggagatgcattgaccaaacgntatgcttatggtaccagcagaagccggcaggccctgtgtgtgatgtaataaagcacgtgagacggcccctgagggactccgtgagcgtattctcgtggactccgaggtcgaaagggacaacggtcacagttcggaccatcaggtggacgccagggcaggaggacgtagcgtgatattattatanaagtacaacanaacaacctattaggttacgttaacttgttcgttacgtaacgttagtcgtaacgacggtacgttaaccgtaccgtcggttcgcgaccgaacggacccgaaccccaacctcgttactaaccgttccgtttccccg

SEQ ID NO: 433828 - DNA, 541 bp, Homo sapiens
  misc_feature: GZ8MTXP01E1A3D.51.12.B01.1.454.CMB.2.raw
  modified_base (271)..(271): a, c, t, g, unknown or other
  modified_base (284)..(284): a, c, t, g, unknown or other
  modified_base (370)..(370): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagaagcccggggctcagtgaagtcncctgcaagacctntggctacaccttcagtggcaacaacgtccactgggtgcgccaggcccctggaccaagggccttgagtggatgggaatgggtttaanctgagaactgggtgccgacaaattatgacacgagggtaggtttcggggcgagggtcagtcgagtcggaaccggggacacgtccactcgaccaacaacttacatggaactgaccagtctgactatttcgacgtacaccggcgttactaattactgtgcgacaagaagccggg

SEQ ID NO: 433829 - DNA, 635 bp, Homo sapiens
  misc_feature: GZ8MTXP01DIWCI.51.12.B01.1.454.CMB.2.raw
  modified_base (274)..(274): a, c, t, g, unknown or other
  modified_base (288)..(288): a, c, t, g, unknown or other
  modified_base (329)..(329): a, c, t, g, unknown or other
  modified_base (405)..(405): a, c, t, g, unknown or other
  modified_base (413)..(413): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggagatcctcttctggtggcagcagccacaagacgcccactcccaggtgcaggtgtgcagtcgtggggctggaggtgaagacggcccgggctcgagtgaaggtcnctgcaagacctcgnggcctacaccttgagtcggacaacgaacgtccagtgggtcncgccacggcccctggacaaggccttggagtggatggggaattgggttaagctaggaagtacgtgggtacgccgtanaaagtttncggacgagagggtacgttcggggactagggtcagtcgagtcggaaccgggtacaccgttaccgaacgttcccggaacctaaactaacgttaccgtaagtccgggtaaaccttcggaacccgtaggttaacgtaacgacccgttaagttccggaaaccgtaccgttaccggttccgttactaacgttaacgtgggacgacgaacgtaagggaacgtccggggg

SEQ ID NO: 433830 - DNA, 585 bp, Homo sapiens
  misc_feature: GZ8MTXP01DMCNM.51.12.B01.1.454.CMB.2.raw
  modified_base (273)..(273): a, c, t, g, unknown or other
  modified_base (324)..(324): a, c, t, g, unknown or other
  modified_base (412)..(412): a, c, t, g, unknown or other
  modified_base (558)..(558): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaaggacgcccggggctcagtgaagtcnctgcaagacctctggctacaccttcagtgacaacaacgtccacgtgggtcncgccgaggcccctggacaggggtccttggagtggatggggaattgggtttaagctaggagtaaacgtgggtcgacgactaaatttagngcacgagggtaggtttcgggggctagggtcagtcgagtacgggacccggggacaccggtcaacgtccgaccaactaacttacatacggaactcgacctggtctagacttattcggaacgtacgacgggccttactaactttaacgnggtcggacgacgaaggaacgggccggg

SEQ ID NO: 433831 - DNA, 584 bp, Homo sapiens
  misc_feature: GZ8MTXP01DXEGN.51.12.B01.1.454.CMB.2.raw
  modified_base (271)..(271): a, c, t, g, unknown or other
  modified_base (284)..(284): a, c, t, g, unknown or other
  modified_base (297)..(297): a, c, t, g, unknown or other
  modified_base (322)..(322): a, c, t, g, unknown or other
  modified_base (400)..(400): a, c, t, g, unknown or other
  modified_base (423)..(423): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagagcccggggctcagtgaaggtcncctgcaagacctntggctacaccttnagtgacaacaacgtcacgtgggtcncgccaggccccctaggacaagggtccttggagtggatggggaattggttaagctgagactgggtcgccgataaattgngacacgagggtaggtttcggggntagggtcagtcgagtacgggaccggggacacgtccacgtccgaccaaccaacttacagtacgggaaactcgaaccctgtcctggaactagtttacggaccgtaaccgaccgggttccttacttaacttacgtggtacgacgacgtaaggaacggtccgggg

SEQ ID NO: 433832 - DNA, 674 bp, Homo sapiens
  misc_feature: GZ8MTXP01APG6H.51.12.B01.1.454.CMB.2.raw
  modified_base (274)..(274): a, c, t, g, unknown or other
  modified_base (291)..(291): a, c, t, g, unknown or other
  modified_base (296)..(296): a, c, t, g, unknown or other
  modified_base (320)..(320): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtgtgtagtcgtggggctggaggtgaagacgcccggggctcgagtgaggtctcngacagcctcgtgctacnccttnagtgacaacacgtcacgtgggtcncgccgacggcccctaggacagggtcttaggaggtggagtgggtattagggtttagtcgtaggaacgtaacgttgggtacgaccgtactaaaagtttcgtcgacgaacgtagggttacgggtttcgggggacgtacggggtacagtaccgaagttacgggaaccggggtacctaccggggttaccacgttacccgacccgtaaactaaaccgtttacgacgttaacgggaaaccttacggaaacccgtacggttcgtaacgtaacgttacgtttacggaaaccgtaaccgtaccgggttaccgttacttaacgttcgtggtaacgaccgtaacgacggtaacggcgggtaaccgg

SEQ ID NO: 433833 - DNA, 704 bp, Homo sapiens
  misc_feature: GZ8MTXP01BDEZ3.51.12.B01.1.454.CMB.2.raw
  modified_base (272)..(272): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcagggtggtgcagtctggggctggaggtgaagagcccggggctcagtgaaggtcncctgcaagacctcgtggctacaccttcagtggacaacaacgtccagtgggtgcgccgacggcccctgggacaagggccttggaggtggatggggtaattgggtttaagtctaggaagaaccgttggggtacgaccggtactaaaagtttagtcggacgtaacggtaggggtacgggttttaccggggggacgtaggggtaccgtaattccgaagttacggggaaccccgggggaacgaccggttacccgacgttacccggaaccctaacctaaacccgtttaagaacggttaacgggtaaacccgttacggaaacccgtaacggttcccttagggttaaccttaacgttttacggaacccgaaccgaaccgggttcccggttacttaacgtttacgtcgggttacgaccggaacgaaggaacgggcccgggg

SEQ ID NO: 433834 - DNA, 593 bp, Homo sapiens
  misc_feature: GZ8MTXP01E1UGO.51.12.B01.1.454.CMB.2.raw
  modified_base (272)..(272): a, c, t, g, unknown or other
  modified_base (324)..(324): a, c, t, g, unknown or other
  modified_base (406)..(406): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagacgcccggggctcagtgaaggtcncctgcaagacctctggctacaccttcagtgacaacaacgtccacgtgggtcncgccaggcccctggacgaagggccttggaggtggagtggggaattgggtttaagcgtaggaagtaacgtgggtcgaccgtanaaattgtgacgacgagggtaggtttcgggggacgtagggtacagtcaagtacgggaaccggggacaccggttaccgagtccgaccaactaacttacagtcggaactgaccagtctacgttactatttcgaacgtacgaccgggttccttacttaattcgtgtcgacgaacgtaaggaacggccgggg

SEQ ID NO: 433835 - DNA, 566 bp, Homo sapiens
  misc_feature: GZ8MTXP01DCZL2.51.12.B01.1.454.CMB.2.raw
  modified_base (273)..(273): a, c, t, g, unknown or other
  modified_base (275)..(275): a, c, t, g, unknown or other
  modified_base (320)..(320): a, c, t, g, unknown or other
  modified_base (515)..(515): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttctggtggcagcagccacaagacgcccactcccaggtgcaggtggtgcagtctggggctggaggtgaaagacgcccggggctcagtgaaggtcncngcagacctctggctacaccttcagtggacacaacgtccagtgggncgccaggcccctggaccaagggccttggagtgggatggggtaaattgggtttaagtctaggaacgacttggggtcgacccgtataaagttatgacgacgtagggtaggttttacggggcgtagggtcagtcacgtaggacccggggacgacgtccagtccgaccaacaacttacagtgaactgaccagtctgacntttcgacgtacacggccgttcgtaattcgtgtcgcgacgaagaacggcggg

SEQ ID NO: 433836 - DNA, 598 bp, Homo sapiens
  misc_feature: GZ8MTXP01BYUIU.51.12.B01.1.454.CMB.2.raw
  modified_base (269)..(269): a, c, t, g, unknown or other
  modified_base (282)..(282): a, c, t, g, unknown or other
  modified_base (317)..(317): a, c, t, g, unknown or other
  modified_base (391)..(391): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagacgcccgggctcagtgaggtcncctgcaagacctntggctacacttcagtggcaacacgtcacgtgggtnccgccaggcccctggacagggccttggagtggatgggaatggtttgctgagtacgtgggtcgccgtataaattntgcacgagggtaggtttcggggacgtagggtcagttcgagtacggacccggggacacggtaccgacgtccgaccctaaccgtaacgtttaccgaagttcgggaaacctggaacccgtagtccgtcggttaacctagttttcgaaccgttaccgaccggttcccgttacttaattacgtggtcgacgaaccgaaggaaggtcccgggg

SEQ ID NO: 433837 - DNA, 679 bp, Homo sapiens
  misc_feature: GZ8MTXP01D02NR.51.12.B01.1.454.CMB.2.raw
  modified_base (305)..(305): a, c, t, g, unknown or other
  modified_base (330)..(330): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcagggtggtgcagtcgtggggctggaggtgaagaacggcccggggctcgagtgaggtctcctgcaagacctcgtggcctacaccttnagtgacaacaacgtccacgtgggcncgccaggcccctggacagggccttggagtggagtggggaattgggtttaagcgtaggagtaaaccgttggggtacgacccggtaataaagtttagtaggacgtaacggtaaggggttacgggttttacgggggaccgtaggggtacctaagtacgtaggttacggggaaccccgggggaactaaccggttccgaacttacccggacccaaaccgtaacctttaacgagttacgggaaaccttcgaacccgtaggttctaggaaccttagtttacggaacccgtaacgaccggggttccgttacttaacgttacgtcggttacggacgaacgtaagggaaacggccgggg

SEQ ID NO: 433838 - DNA, 769 bp, Homo sapiens
  misc_feature: GZ8MTXP01CLOVK.51.12.B01.1.454.CMB.2.raw
  modified_base (339)..(339): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagccccgctcctcaccatggactggacctggaggatcctcttcttggtggcagcagccaacaagacgcccactcccaggtgcaggtggtgcagtctgggggctggaggtgaaaggacggcccggggctcgagtgaacggtctcctgacaaagacctcgtggcctacaccttcagtggacaaacgaacgtcacgtgggtcnccgccaggcccctagggaacaagggtccttggaggtggagtggggtaacttgggttttaagcgttagggaagtaaaccgttggggtacgacccgaactaaaaatttagtcggaccgaaggtaaaggggttaagggttttccgggggggacctaaggggggttaccaaaggttaccgtaaggtacggggtaaaccccggggggaactaaacccgggtttcccgaaacttcccgggaacccaaaaccgtaaaaccccgtttaaacgtaaacggtaaccgggtaaacctacggtaaacccgaaggttaacctaacggttaaccgttaacgtttaaccgggaaacccgtaaccggttacccgggttcccgttaacgttaacgtttaccggtcgggtaaccggacggttaaacgtaaacgggaaccgggccgggg

SEQ ID NO: 433839 - DNA, 554 bp, Homo sapiens
  misc_feature: GZ8MTXP01CEF5M.51.12.B01.1.454.CMB.2.raw
  modified_base (274)..(274): a, c, t, g, unknown or other
  modified_base (284)..(284): a, c, t, g, unknown or other
  modified_base (290)..(290): a, c, t, g, unknown or other
  modified_base (293)..(293): a, c, t, g, unknown or other
  modified_base (313)..(313): a, c, t, g, unknown or other
  modified_base (477)..(477): a, c, t, g, unknown or other
  modified_base (490)..(490): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctggaggtgaagacggcccggggctcagtgaagtcnctgcagcctngctacnctnagtgcaacacgtcagtggtncgccaggcccctggacaggcccttggagtggagtgggaattgggtttgctaggagtaactgggtcgccgataaagttatggacacgtagggtaggtttacgggggacgtagggtcagttcgaagtcgggaaccggggacacgtccgactcgaccaacaacttanagtgaactgaccngtctgactagttcgaactcgacgggttcttacgttaattcgtgtgcgacgaaggaacggccggg

SEQ ID NO: 433840 - DNA, 568 bp, Homo sapiens
  misc_feature: GZ8MTXP01A8EEO.51.12.B01.1.454.CMB.2.raw
  modified_base (280)..(280): a, c, t, g, unknown or other
  modified_base (332)..(332): a, c, t, g, unknown or other
  modified_base (407)..(407): a, c, t, g, unknown or other
  modified_base (454)..(454): a, c, t, g, unknown or other
  modified_base (543)..(543): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcagggtggtgcagtctgggggctggaggtgaaggaacggcccgggggctcgagtgaaggtcncctgcaagcctgtggcctacaccttcagtcgacaacaacgtccagtgggtcncgccacggcccctggacagggccttggagtggatgggaattgggttgtctgacgactgggtacgcgataaattgngacacgagggtagttcggggctagggtcagtcgagtcgaccgggganacggtcatccgaccacaacttacagtcggtaactcgaacctggtctagacctagttcgaacgtacgccgggttccttacttaattacgnggtcgacgaacgaaggaacgccggg

SEQ ID NO: 433841 - DNA, 691 bp, Homo sapiens
  misc_feature: GZ8MTXP01C934Z.51.12.B01.1.454.CMB.2.raw
  modified_base (275)..(275): a, c, t, g, unknown or other
  modified_base (301)..(301): a, c, t, g, unknown or other
  modified_base (327)..(327): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggagatcctcttcttggtggcagcagccacaagagccccactcccaggtgcaggtggtgcagtctgggggctggaggtgaagacggcccggggctcgagtgaaggtcncctgcaagacctctggctacaccttnagtggcaaacacgtccacgtgggtcncgccacggcccctggacgaagggtccttggagtggagtggggaattgggtttaagtctagggaagaaccgttgggtacggacccgaataaaagtttgacggacctaaacggtaaggggttaacgggtttccggggggactagggggtaccaagttccgaaggttacggggaaccccgggggaacctaccgggttacccaaacgttcccggaaccctaaacccgtaaacctttaacgaaacgttcggaaaaccgttcggaacccctaggttaacctacggaaaccttagtttacggaaacccgtaacgccggttccgttacttaattaccgtggtacgacccggaagtaacgggaacggccgggg

SEQ ID NO: 433842 - DNA, 549 bp, Homo sapiens
  misc_feature: GZ8MTXP01BW4IV.51.12.B01.1.454.CMB.2.raw
  modified_base (276)..(276): a, c, t, g, unknown or other
  modified_base (403)..(403): a, c, t, g, unknown or other
  modified_base (427)..(427): a, c, t, g, unknown or other
  modified_base (492)..(492): a, c, t, g, unknown or other
  modified_base (496)..(496): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcagggtggtgcagtcgtggggctgaggtgaagacggcccggggctcagtgaaggtcncctgcaagacctctggctacaccttcagtcggacaacacgtccactgggtcgcgccaggcccctggacaaggcctggagtggatgggaattggttaagtctgagaacgtggtcgccgacaaattagngtacgagagggtagtttcgggggntaggggtcatcgagtcggaccggggacacggtcagtccgacaactaactacgatggaactgaccngtcngactattgaacgcgaccggcttcgtaataccgtgtgcgactaagaacggcggg

SEQ ID NO: 433843 - DNA, 559 bp, Homo sapiens
  misc_feature: GZ8MTXP01B3L8H.51.12.B01.1.454.CMB.2.raw
  modified_base (268)..(268): a, c, t, g, unknown or other
  modified_base (271)..(271): a, c, t, g, unknown or other
  modified_base (411)..(411): a, c, t, g, unknown or other
  modified_base (494)..(494): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccgggctcagtgaggtcnccngcaagacctctggctacaccttcagtggacaacaacgtccacgtgggtcgccgccgacggccccctaggaccgaaggggcccttggagtggatggggaattgggtttaagctggagaacgtgggtacgcccgataaattntgacacgaggtaggtttcggggcagggtcatcagtggaccgggacacgtccatccgaccacgaacttacagtggaactgaccngtctgactagttcgaacgacgaccggttccgttactaattacgtgtgcgacaaggaacggccggg

SEQ ID NO: 433844 - DNA, 571 bp, Homo sapiens
  misc_feature: GZ8MTXP01EJWD3.51.12.B01.1.454.CMB.2.raw
  modified_base (273)..(273): a, c, t, g, unknown or other
  modified_base (285)..(285): a, c, t, g, unknown or other
  modified_base (320)..(320): a, c, t, g, unknown or other
  modified_base (418)..(418): a, c, t, g, unknown or other
  modified_base (449)..(449): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagacgcccggggctcagtgaaggtcnctgcaagacctntgctacacttcagtgcaacaacgtcacgtgggtcnccgccgacggcccctggacaagggtccttggagtggatgggaatggtttgctagagactgggtcgcgtactaattatgcacgaggtaggtttcggggngtagggtcagtcgagtacgggacccgggganaccggtcagtccgacctaaccaactttacgaagtacggtaactacggaaccctagtctagactagtttcgaccgacgacgggttcccttattaattacgtgtcgcgagtaagaacggccggg

SEQ ID NO: 433845 - DNA, 748 bp, Homo sapiens
  misc_feature: GZ8MTXP01CL9GO.51.12.B01.1.454.CMB.2.raw
  modified_base (276)..(276): a, c, t, g, unknown or other
  modified_base (288)..(288): a, c, t, g, unknown or other
  modified_base (296)..(296): a, c, t, g, unknown or other
  modified_base (301)..(301): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctggaggtgaagacggcccggggctcgagtgaaggtcncctgcaagcctntggctacnccttnagtgacaacacgtcagtggtcgcgccgacggcccctaggacgaagggtccttggaggtggagtggggaattgggtttaagtcgtagggaacggtaacgtggggtcgacccggtaactaaaagtttgtacggacgtacggtaaggggttacgggttttaccgggggacgtaagggggtccaaggttaccgaaggttaccgggggaaccccgggggtaaccgttaacccgggttacccgtaaccgttacccgggaaccctaaaccgttaaaccgtttaacgtaaacgtttaccggggaaaccttacggaacccgtaagggttaacccgttaaggttaaaccgttacggttttacggaaacccggtaaccgttacccggggttacccgttacgtttaacgtttaccgttgggtacggaccggttaacgtaacgggaaacggtcccggggg

SEQ ID NO: 433846 - DNA, 619 bp, Homo sapiens
  misc_feature: GZ8MTXP01C9YFD.51.12.B01.1.454.CMB.2.raw
  modified_base (277)..(277): a, c, t, g, unknown or other
  modified_base (280)..(280): a, c, t, g, unknown or other
  modified_base (290)..(290): a, c, t, g, unknown or other
  modified_base (303)..(303): a, c, t, g, unknown or other
  modified_base (429)..(429): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggagatcctcttcttggtggcagcagccacaagacgccccactcccaggtgcagggtggtgcagtcgtggggctggaggtgaagacggcccggggctcgagtgaaggtcnccngcaagacctnggcctacaccttnagtgacaacgaacgtccacgtgggtcgccgccgacggccccctgggaacaaggggtccttaggagtggagtggggaattgggtttaagcgtaggaacgtaacgtgggtacgccgaataaatttagngacgaacgtagggtacggtttcggggactagggtacagtcgagtcgggaacccggggacaccggtcaacgtccgaccctaactaacttacgagtacggtaaactcgaaccctggtcctagaccttagttcggaaccgacgttaccgggttccttacttaattacgtggtcgacgacgaaggaacggcggg

SEQ ID NO: 433847 - DNA, 536 bp, Homo sapiens
  misc_feature: GZ8MTXP01CLWZO.51.12.B01.1.454.CMB.2.raw
  modified_base (267)..(267): a, c, t, g, unknown or other
  modified_base (486)..(486): a, c, t, g, unknown or other
  modified_base (512)..(512): a, c, t, g, unknown or other
  modified_base (520)..(520): a, c, t, g, unknown or other
  modified_base (525)..(525): a, c, t, g, unknown or other
  modified_base (528)..(528): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtgtgcagtctggggctgaggtgaagacgcccgggctcagtgaagtcncctgcaagacctctggctacaccttcagtcgacaacaacgtccacgtgggtcgcgccaggcccctggacaaggggccttggagtggatgggaattgggtttaagctgagactggtgaccgacaaattagtgacacgagggtacgtttcggggcagggtcagttcagtcggaaccggggacacgtccatccgaccaacaacgttacagtggaactgaccngtctgactattgacgacacgggcttntaatacgngtcgnacngaacgcgg

SEQ ID NO: 433848 - DNA, 610 bp, Homo sapiens
  misc_feature: GZ8MTXP01BJ2C5.51.12.B01.1.454.CMB.2.raw
  modified_base (232)..(232): a, c, t, g, unknown or other
  modified_base (270)..(270): a, c, t, g, unknown or other
  modified_base (272)..(272): a, c, t, g, unknown or other
  modified_base (282)..(282): a, c, t, g, unknown or other
  modified_base (294)..(294): a, c, t, g, unknown or other
  modified_base (318)..(318): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtgtgcagtcnggggctgaggtgaagacggcccggggctcagtgagtcncngcaagacctntgctacaccttnagtcgcaacaacgtccagtgggtncgccgaggccccctggacaagggtccttggagtggagtgggaattgggttgcgtagagtacgtgggtacgccgtataaagttagtcgacacgtaggtaggtttacggggcgtaggggtacagttccgaaggtacggacccggggacgtaccggttaccagtacccggacccaaaccgtaaacctttacgaacgttacgggaaactacggaccctaggtaactcgaactacgtttagaccgtaacgaccgttccgttacgtaattacgtgtcgacgacgaagaaggaaccggg

SEQ ID NO: 433849 - DNA, 728 bp, Homo sapiens
  misc_feature: GZ8MTXP01DDMMT.51.12.B01.1.454.CMB.2.raw
  modified_base (276)..(276): a, c, t, g, unknown or other
  modified_base (334)..(334): a, c, t, g, unknown or other
  modified_base (449)..(449): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcaggtggtgcagtcgtggggctggaggtgaagacggcccggggctgagtgaaggtcncctgacaagacctcgtggcctacaccttcgagtcggacaaacacgtccacgtgggtcnccgccgacggccccctagggaaccgaaggggtcccttggaggttgggaagtgggggtaaatttgggttttaagctagggaacggtaacgtggggtcgacccgtaataaaagtttnacggaccgaagtaaggggttagggtttacgggggactaggggttacccagttacgaaggttacgggggaaaccccgggggtactaaccgggttaccccgtaagttaccccggaaccctaaaccgtaaacctttaaccgtaaaggttaccggtaaaccgtcgaaacccgtaggttaaccctagggaaaccttaggtttacgaaacccggtaaccgttacccggggttccttacttaacgttaccgtggtacggaccgaacgtaacgggaacgggccgggg

SEQ ID NO: 433850 - DNA, 590 bp, Homo sapiens
  misc_feature: GZ8MTXP01EDH3R.51.12.B01.1.454.CMB.2.raw
  modified_base (278)..(278): a, c, t, g, unknown or other
  modified_base (289)..(289): a, c, t, g, unknown or other
  modified_base (297)..(297): a, c, t, g, unknown or other
  modified_base (302)..(302): a, c, t, g, unknown or other
  modified_base (525)..(525): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaacccccctgagacgccccgctcctcaccatggactggacctggaggatcctcttcttggtggcagcagccacaagacgccccactcccaggtgcaggtggtgcagtcgtggggctggaggtgaagacggcccggggctcagtgaaggtcnctgcagacctntggctacnccttnagtgacaacacgtcacgtgggtcgcgccgacggcccctggacgaggggtccttggaggtggagtggggtaaattgggtttaagtcgtaggagtacgtgggtcgaccgtactaaattgtgacgacgtagggtaggtttcggggctagggtcagtcgagtcggaccggggacacgtcgacgtccgaccaactaacttacgagtcgaactcgacctgtctgaactntttcggaacgtaccgaccgggttccttacgtaattacgtgtcgacgacgtaacggaaggccgggg

SEQ ID NO: 433851 - DNA, 582 bp, Homo sapiens
  misc_feature: GZ8MTXP01E07CE.51.12.B01.1.454.CMB.2.raw
  modified_base (270)..(270): a, c, t, g, unknown or other
  modified_base (318)..(318): a, c, t, g, unknown or other
  modified_base (343)..(343): a, c, t, g, unknown or other
  modified_base (364)..(364): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttctggtggcagcagccacaagagcccactcccaggtgcaggtggtgcagtctggggctgaggtgaagagcccggggctcagtgaaggtcncctgcaagcctctggctacaccttcagtggcaacacgtccactgggtncgccaggcccctggacaggccttgngtggatgggaattgggtttcncgtagagtacgtggtcgccgaataaattagcgaccgaacggtagggttacggtttaccggggactagggtcagtcgaggtcgggacccgggtacaccgtccacgtcccgacctaactaacctacgacgtacggtaacctcgacctgtctagactagttcgaaccgtaccgccggttcccttacttaactacgtgtacgacgacgaacggaacggcggg

SEQ ID NO: 433852 - DNA, 749 bp, Homo sapiens
  misc_feature: GZ8MTXP01D64WV.51.12.B01.1.454.CMB.2.raw
  modified_base (282)..(282): a, c, t, g, unknown or other
  modified_base (302)..(302): a, c, t, g, unknown or other
  modified_base (330)..(330): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgcccccgctcctcaccatggactggacctggaggatcctcttcttggtggcagcagccacaagacgccccactcccaggtgcaggtggtgcagtcgtgggggctggaggtgaaggacggcccggggctcgagtgaaggtcncctgacaagcctgtgctacncttcagtgacaacacgtccacgtgggcnccgccgacggcccctggaacgaagggccttaggaggtggagtggggtaattgggtttgcgtaggaacgtaacgtggggtacgcccgtaaataaagtttcgaggacgtaacggtaggggttacgggttttacggggggactaagggggttccaaaggttaccgaaagggttacccgggggaaacccccgggggtaactaacccggggttacccaaacgttccccgggaaacccctaaaacgttaacctttaaacggaacggttacgggaaacccttcggaaaccccgtaggttaacttaacggaacgttaacgtttcgggaaacccgtaacccggttaccggggttccctttaacgtttaacgtttaaccgggtcgggtacggaaccggttaacggtaaccgggttaaccggggcccggg

SEQ ID NO: 433853 - DNA, 679 bp, Homo sapiens
  misc_feature: GZ8MTXP01BYLE4.51.12.B01.1.454.CMB.2.raw
  modified_base (278)..(278): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgcccccgctcctcaccatggactggacctggaggatcctcttcttggtggcagcagccacaagacgccccactcccaggtgcagggtggtgcagtctggggctgaggtgaagacggccccggggctcagtgaaggtcncctgacaagacctgtcggctacacccttcaggtgacaaacacgtccacgtgggtcgcgccacggcccctggacaggtccttggagtggagtgggaattgggtttaagtcgtaggagtaacgtgggtcgaccggtactaaagtttatcggacacggtaggggttagggtttccgggggacgtaaggggtcaagttcgaaggttacgggaccccgggggtacaccggtccgacttccggaaccctaaaccaactttacgaacgttcggggaaaccttcgggaacccctaggtaaccgttacggttacgttacgtttacggaccggtaaccggttacccgggttccgtttacttaacgtttacggtcggtacggccggaaacgtaacgggaacgggtcccgggg

SEQ ID NO: 433854 - DNA, 557 bp, Homo sapiens
  misc_feature: GZ8MTXP01D2YJO.51.12.B01.1.454.CMB.2.raw
  modified_base (276)..(276): a, c, t, g, unknown or other
  modified_base (278)..(278): a, c, t, g, unknown or other
  modified_base (286)..(286): a, c, t, g, unknown or other
  modified_base (298)..(298): a, c, t, g, unknown or other
  modified_base (320)..(320): a, c, t, g, unknown or other
  modified_base (398)..(398): a, c, t, g, unknown or other
  modified_base (488)..(488): a, c, t, g, unknown or other
  modified_base (509)..(509): a, c, t, g, unknown or other
  modified_base (530)..(530): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatccttcttcttggtggcagcagccacaagacgcccactcccaggtgcaggtggtgcagtcgtggggctggaggtgaagacggcccgggctcgagtgaagtcncngcagactnggctacaccttnagtgacaacacgtcacgtggcncgcacggcccctggacgagggcttggagtgatgggaattgggtttgctagacgtaacgtgggtcgcccgataaagttngacacgtaggtaggtttcggggcagggtcagtcgagtcggaccggggacacggtccagtcccgacaactaacttacagtggaactgaccngtctgactgtttgaccgtacncgggttccttactaattacgngtcgacgacgtaaggaacgtaaccggg

SEQ ID NO: 433855 - DNA, 600 bp, Homo sapiens
  misc_feature: GZ8MTXP01EBGOZ.51.12.B01.1.454.CMB.2.raw
  modified_base (301)..(301): a, c, t, g, unknown or other
  modified_base (326)..(326): a, c, t, g, unknown or other
  modified_base (352)..(352): a, c, t, g, unknown or other
  modified_base (354)..(354): a, c, t, g, unknown or other
  modified_base (411)..(411): a, c, t, g, unknown or other
  modified_base (417)..(417): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctgaggtgaaggacggcccggggctcgagtgaaggtctcctgcaagacctctggctacacttnagtgcaacaacgtcacgtgggtacncgacgccgtccgaggagagtcagtgngnggtgtagttgtctgagaacgtcgtgcgactaatagtgcacgagtaggttgggtcggngtacgnactgagtacgggaccgacgtacctacgacgtaccgaactaacctacgtagtaacggtacgtacgtaccgaacgtcgtaacgtacgttaactttacggttacgaaccgtaacccgggttccggttccgtttaaacgttaaccttcggtggaacggaccggaaagtaacgggcgggtaaccgggg

SEQ ID NO: 433856 - DNA, 552 bp, Homo sapiens
  misc_feature: GZ8MTXP01A535I.51.12.B01.1.454.CMB.2.raw
  modified_base (271)..(271): a, c, t, g, unknown or other
  modified_base (297)..(297): a, c, t, g, unknown or other
  modified_base (322)..(322): a, c, t, g, unknown or other
  modified_base (394)..(394): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggagatcctcttcttggtggcagcagccacaagacgcccactcccaggtgcaggtggtgcagtctggggctggaggtgaagagcccggggctcagtgaaggtcncctgcaagacctctggctacaccttnagtggcaacaacgtccacgtgggtncgccaggcccctggacagggccttgagtggatgggaatgggtttaagctagagactgggtgccgacaaattntgcacgaggtaggtttcgggggctaggggtcagtcagtggacccggggacacggtcagtccgacctaacaacgttacagtcggaaactgaccagtcctggactagtttcgacgtacgacggccgttctaattacgtgtgcgaacaaggaacgccgggg

SEQ ID NO: 433857 - DNA, 717 bp, Homo sapiens
  misc_feature: GZ8MTXP01D5AQK.51.12.B01.1.454.CMB.2.raw
  modified_base (275)..(275): a, c, t, g, unknown or other
  modified_base (288)..(288): a, c, t, g, unknown or other
  modified_base (297)..(297): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgcccacctcccaggtgcgaggtggtgcagtcgtggggctgaggtgaagacggcccggggctcagtgagtcnctgacaagacctntcggctacnccttcagtcgacaacaacgtccacgtgggtcgccgccgacggcccctagggaaccgaaaggggtccttaggaacggttggggaagttggggggtaaatttaggggttttaacgtcgtagggtaacggtaaaccgttggggtacggacccggtaactaaaagtttagcggacgaacggtagggggttagggttttccgggggacgtaaggggttcagttccgaaggttacgggaacccgggggactaacccggtaccgaacgtacccgaaccctaaacctaacgtttaacgaacgttacgggtaaaccttacggaaccctaggttcttacggaaacttacgtttacggaaacccggtaccgttaaccgggttccttacgttaatttacgtgttcggacgaacgaacgggaacggtccgggg

SEQ ID NO: 433858 - DNA, 531 bp, Homo sapiens
  misc_feature: GZ8MTXP01ATGND.51.12.B01.1.454.CMB.2.raw
  modified_base (269)..(269): a, c, t, g, unknown or other
  modified_base (278)..(278): a, c, t, g, unknown or other
  modified_base (284)..(284): a, c, t, g, unknown or other
  modified_base (288)..(288): a, c, t, g, unknown or other
  modified_base (307)..(307): a, c, t, g, unknown or other
  modified_base (459)..(459): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctgggctgaggtgaagagcccggggctcagtgaggtcnctgcagctngctacncttnagtgcaacacgtcatggtncgccagccctggacaggctgagtgatgggaatggttgctgagacgtggtcgcgactaaattatgacacgagggtagtttcggggcagggtcagtcgagtcggaccgggacacggtcatccgaccaacaacgttacagtcggtaactcgaccngtcgtagacgtattcgaacgacgacggccgttcctaattacgtggtcgacggttacaagggaacgtccgggg

SEQ ID NO: 433859 - DNA, 589 bp, Homo sapiens
  misc_feature: GZ8MTXP01DB6GR.51.12.B01.1.454.CMB.2.raw
  modified_base (284)..(284): a, c, t, g, unknown or other
  modified_base (286)..(286): a, c, t, g, unknown or other
  modified_base (302)..(302): a, c, t, g, unknown or other
  modified_base (404)..(404): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgccccactcccaggtgcgagggtggtgcagtcgtggggctggaggtgaaaggacggcccggggctcaggtgaacggtcncngcaagcctgcgctacnccttcagtgacaacacgtcagtgggtcgcgccgacggcccctggacgaggtcctggagtggagtgggaattgggttgctgagacgtgggtcgcgataaattntcggacacgagggtaggttcggggacgtaggggtcagttcgacggtacgggaccccgggggtacaccggtcctaagtaccgaccaacgtaacttacagtacggaaactggaccctgtcctgaacttagttcgaaccgacaccgttcgttacttaatacgtgtcgcgaacgtaaggaacggccggg

SEQ ID NO: 433860 - DNA, 614 bp, Homo sapiens
  misc_feature: GZ8MTXP01D8AM3.51.12.B01.1.454.CMB.2.raw
  modified_base (277)..(277): a, c, t, g, unknown or other
  modified_base (298)..(298): a, c, t, g, unknown or other
  modified_base (330)..(330): a, c, t, g, unknown or other
  modified_base (578)..(578): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgcccactcccaggtgcaggtgtgcagtcgtggggctggaggtgaaggacggcccggggctcgagtgaaggtcnctgcaagacctgtggcctacnccttcgagtgacaacaacgtccacgtgggtcncgccgacggcccctaggacagggtccttggagtggatggggaattgggtttaacgtcgtagagtaacgtgggtcgaccgtataaagttgtggacgaacgtagggtacggtttacggggacgtagggtccagtcgaaggtcgggaacccgggacgtaccgtccgacgtaccggaccaactaacgttacgaagttacggaacttacgcctacgtcttagacttagtttcgaaccgtcgacgttcccgttnttaacttacgtgtacgacgacgaaggaacgggcggg

SEQ ID NO: 433861 - DNA, 626 bp, Homo sapiens
  misc_feature: GZ8MTXP01DGAFC.51.12.B01.1.454.CMB.2.raw
  modified_base (308)..(308): a, c, t, g, unknown or other
  modified_base (436)..(436): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgccccactcccaggtgcagggtggtgcagtcgtggggctggaggtgaagacggcccggggctcgagtgaaggtctcctgacaagacctcgtggcctacaccttnagtcggacaacaacgtccacgtgggtcgcgccgacggcccctaggacgagggtccttggagtggagtggggtaattgggtttaagtcgtaggaagtaacgttggggtacgaccggactaaaagtttgnggacgaacggtaggggttacgggtttacgggggacgtaaggggttcagtacgtaagtacggggaccccggggactaccggttaccagtacccgaccaactaacttacagtacggaactcgaccagtctagactagttacgacgtacacggttccgttataattacgtgtcgacgacgtaaggaaggcggg

SEQ ID NO: 433862 - DNA, 773 bp, Homo sapiens
  misc_feature: GZ8MTXP01A5GOH.51.12.B01.1.454.CMB.2.raw
  modified_base (277)..(277): a, c, t, g, unknown or other
  modified_base (332)..(332): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagccccgctcctcaccatggactggacctggaggatcctcttcttggtggcagcagccacaagacgcccactcccaggtgcagggtggtgcagtcgtggggctggaggtgaagacggcccggggctgagtgaaggtcnctgacaagacctcgtggctaccacttcgagtcgacaacgacgtccacgtgggtcnccgccgacggcccctggacgagggtccttggagtggagtgggaattgggttaagtcgtaggagtaacgtgggtcgaccgtactaaaagtttgacggacaacggtacggggttacgggttttaccgggggactaagggggtccaaggttaccgaaaggttaccggggaaacccggggggtaaccgtaccgggtacccgtaaaccgtacccggtaaccctaaaccgtaaaccgtttaaacgaaacgggttaaccggtaaaacccgttacggaaccccgttaaggttaacccgttaacgggttaaaccgtttaaacggttttaccgggaaaccccggttaaacccggttaacccggggttccccgttttaccttaacggttttaaccccgtgggttaaccgggaccgttaacggtaaacggggttaaccggtaaccccgggggg

SEQ ID NO: 433863 - DNA, 551 bp, Homo sapiens
  misc_feature: GZ8MTXP01AG23J.51.12.B01.1.454.CMB.2.raw
  modified_base (275)..(275): a, c, t, g, unknown or other
  modified_base (277)..(277): a, c, t, g, unknown or other
  modified_base (287)..(287): a, c, t, g, unknown or other
  modified_base (294)..(294): a, c, t, g, unknown or other
  modified_base (321)..(321): a, c, t, g, unknown or other
  modified_base (384)..(384): a, c, t, g, unknown or other
  modified_base (481)..(481): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctggaggtgaagacggcccgggctcgagtgaaggtcncngcaagacctntgctacnccttcagtcgcaaacacgtccagtggncgccaggcccctggacaaggccttggagtggatggggaattggttaagctgagtacgtgggtnccgtataaattatgacacgaggtagtttcggggcagggtcattcgagtcggaccgggacacgtccatccgtacacaacttacagtcggaactgaccngtctgactgtttcgaacgacgaccgggccttactaacttacgtgacgaccggaataacggaacggccggg

SEQ ID NO: 433864 - DNA, 574 bp, Homo sapiens
  misc_feature: GZ8MTXP01EOT7U.51.12.B01.1.454.CMB.2.raw
  modified_base (278)..(278): a, c, t, g, unknown or other
  modified_base (287)..(287): a, c, t, g, unknown or other
  modified_base (291)..(291): a, c, t, g, unknown or other
  modified_base (304)..(304): a, c, t, g, unknown or other
  modified_base (317)..(317): a, c, t, g, unknown or other
  modified_base (334)..(334): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgcccactcccaggtgcaggtggtgcagtcgtggggctggaggtgaagaacggcccggggctcgagtgaaggtcncctgcaacnctcncgctactactcgngcgacacacgtcncgtggcgcgcgcgccgnacgacgaggtgtggagtagtagtggtagttaggttacgtgtagacgtacgtaggtcgacgtaataatagagacgagtaggtacggtacgggacggtacgtacgacgtacgacgggtacgggacggaccgaccgtactacgtccgacctaactaactacgtacgtacgtacgtaacgacgttagtcgacgtactacgttacgacgacgcgtcgtaacgttacgtacgttagtcgaacgaag

SEQ ID NO: 433865 - DNA, 654 bp, Homo sapiens
  misc_feature: GZ8MTXP01AMRKG.51.12.B01.1.454.CMB.2.raw
  modified_base (278)..(278): a, c, t, g, unknown or other
  modified_base (280)..(280): a, c, t, g, unknown or other
  modified_base (296)..(296): a, c, t, g, unknown or other
  modified_base (386)..(386): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgcccccgctcctcaccatggactggacctggaggatcctcttcttggtggcagcagccacaagacgcccactcccaggtgcagggtggtgcagtcgtggggctggaggtgaaggacggcccgggctcgagtgagtcncngcaagctcgtgctacncttcagtcgacaacacgtcacgtgggcgccgccgacggccccgtaggacgaaggggtccttaggagtggagtggggtaattgggtttaancgtaggaagtaacgtggggtacaccgtaactaaaagtttcgacggacgtaacgtaagggggtacggttttccgggggacgtacggggtacctaagttcgaacggtcggggaacccggggacctaccggttccgaacgtcccgaaccaaccgtaaacttacgaagtacggtaaacctcgaacccgtgtcctaagaccgttaagttcgaaccgtaccggttaccggttccttacgtaattcgtgtacgacgttacgaaggaacggccggg

SEQ ID NO: 433866 - DNA, 800 bp, Homo sapiens
  misc_feature: GZ8MTXP01DCL06.51.12.B01.1.454.CMB.2.raw
  modified_base (279)..(279): a, c, t, g, unknown or other
  modified_base (294)..(294): a, c, t, g, unknown or other
  modified_base (304)..(304): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgcccactcccaggtgcaggtggtgcagtcgtggggctggaggtagaagacggcccggggctcgagtgaaggtcncctgacaacgacctntcggcctacnccttgagtcggaccaaaccgaacgtccacgtgggtcgcgccgacggcccctaggacgaagggtccttggagtggagtggggtaaattgggtttaagcgtagggaacgtaacgttggggtacgacccgtaataaaagtttgacggaccgaacggttaacgggggttaacggggttttaccggggggaccgtaagggggtttaccaagttaccgaacggttaaccgggggtaaccccggggggaaccttaaccccggggttacccttaaaccggaccccggtaaaacccctaaacccgttaaaaccgttttaacccggtaagtttaaccggggaaacctttacgggaaaccccttaaggggttaacttacgggaaaccttttaaaggtttacccgggaaacccggaacggttaaccccggggttccgtttaactttaacgttaaccgttgggttaaccgggacggttaacccgaaaggggttaaccggggtcccgggg

SEQ ID NO: 433867 - DNA, 620 bp, Homo sapiens
  misc_feature: GZ8MTXP01D274O.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgcccccgctcctcaccatggactggacctggaggatcctcttcttggtggcagcagccacaagacgcccactcccaggtgcaggtggtgcagtcgtggggctggaggtgaagacggcccggggctcgagtgaaggtctcctgcaagacctcgtggcctactaccttcaggtcggacaaaccaacgtccacgtgggtcgcgccgacggccccctaggacgaagggtccttggaggtggatggggtaattgggtttaagcgtaggaacgtaacgtggggtacgtaccgtaactaaaagtttgtacggacgacgtaggggttaacggtttcgggggacgtaggggtccagttccgagtaccgggaacccggggacaccggttccaacgtccgaccaactaacgttacagtacgaactgacctagtctagactagttgacgacgacggttcttataattacgtgtcgcgacaaggaacgcggg

SEQ ID NO: 433868 - DNA, 628 bp, Homo sapiens
  misc_feature: GZ8MTXP01D374C.51.12.B01.1.454.CMB.2.raw
  modified_base (275)..(275): a, c, t, g, unknown or other
  modified_base (277)..(277): a, c, t, g, unknown or other
  modified_base (285)..(285): a, c, t, g, unknown or other
  modified_base (291)..(291): a, c, t, g, unknown or other
  modified_base (294)..(294): a, c, t, g, unknown or other
  modified_base (315)..(315): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgcccactcccaggtgcaggtggtgcagtcgtggggctgaggtgaaggacggcccgggctcgagtgagtcncngcagcctngctacnctnagtgacaacacgtcagtggcnccgccgacggcccctggacgagggtccttggagtggatgggtaattgggtttgcgtgagtaacgtgggtcgaccgtaataaacgttgacgtacgtaacggtaggggttaacgggtttccgggggacgtaaggggttccaagtcgtaaggtaccgggaacccgggggacctaccggtaccgtacgtacccgacccgtaaacctaacgtttacgaacgttgggaaacctcgaaccctaggttctacggactagtttcgaacgtaccgttacggttccttacttaagtcgtgtcgacgacgaacggaacggccggg

SEQ ID NO: 433869 - DNA, 558 bp, Homo sapiens
  misc_feature: GZ8MTXP01DK37F.51.12.B01.1.454.CMB.2.raw
  modified_base (326)..(326): a, c, t, g, unknown or other
  modified_base (477)..(477): a, c, t, g, unknown or other
  modified_base (490)..(490): a, c, t, g, unknown or other
tcagcgatcgtatacacgaccggtgctcgatttagtagtgtagattccgcgggcacgaccggtgctcgatttgtagtgtagattccgcgggggatcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagaacgcccggggctcagtgaaggtctcctgcaagacctctggctacaccttcagtggacaacaacgtccacgtgggtcncgccaggcccctggacagggccttggagtggatggggaattgggtttaagcgtagagtaacgtggtgccgactaaattgtgcacgagggtagtttcggggctagggtcagtcgagtacggaccggggacacgtcatccgacacgaacttanagtgaactgaccngtctgactagttcgaacgtacgaccggttccgttacttaattacgtgtcgcgacaaggaacggccggg

SEQ ID NO: 433870 - DNA, 629 bp, Homo sapiens
  misc_feature: GZ8MTXP01B7NSV.51.12.B01.1.454.CMB.2.raw
  modified_base (284)..(284): a, c, t, g, unknown or other
  modified_base (311)..(311): a, c, t, g, unknown or other
  modified_base (430)..(430): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccaacaagacgccccactcccgaggtgcgagggtggtgcgagtcgtggggctggaggtgaaggacggcccggggctcgagtggacgtcncctgcaacgcctcgtgcctacaccttnagtcgacaacacgtccagtggtcgccgccgacggtcccctaggacgagggtccttaggaggtggagtgggtaagttgggtttaagcgtaggaacgtacgtgggtcgaccgataaattcnggacacggtagggtacgggttcgggacgtagggtcatcgaggtacgggacccgggactacgtccaacgtccgaacctaacgtaacttacgaagtacgtaactcgacctagtcgtagttaccgtattacggaaaccgtaccgttaccggttcttacttaacgttcgtaagtacgaccgaacgaacgggttaacggccggg

SEQ ID NO: 433871 - DNA, 632 bp, Homo sapiens
  misc_feature: GZ8MTXP01C8U0O.51.12.B01.1.454.CMB.2.raw
tcagcgatcgtatacacgaccggtgctcgatttagtagtgtagattcgcaggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgaccaaaccgatatgcttattgtacagcagagccggcaggccctgtgttggtgatgtataaagacactggagacggccctcgagggactcccgtgagcgtatttcctcgtggctccgaggtcgagggaacaacgggtcactagttcggcctagtcgaggttggacgtccgagggcgaaggaagggacggaacggtcgtagtaacgttaatttaattacggttacgtaaacttaccaaaacgtacggaacctaacccttaagtttacgggttaaacctttaagttcggttaccgttaccggggtaaactcggtaccgaaccgtaaacggttcccgaacccggttccgttacggggttccacggaaccccgaaaggccccaaccccgacttcgttccgaacctttcccg

SEQ ID NO: 433872 - DNA, 669 bp, Homo sapiens
  misc_feature: GZ8MTXP01BOVAZ.51.12.B01.1.454.CMB.2.raw
  modified_base (277)..(277): a, c, t, g, unknown or other
  modified_base (289)..(289): a, c, t, g, unknown or other
  modified_base (297)..(297): a, c, t, g, unknown or other
  modified_base (302)..(302): a, c, t, g, unknown or other
  modified_base (326)..(326): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagccccgctcctcaccatggactggacctggaggatcctcttcttggtggcagcagccacaagacgcccactcccaggtgcaggtggtgcagtcgtggggctggaggtgaaggacgcccggggctcgagtgaaggtcncctgcaagcctntggctacnccttnagtgacaacacgtccagtgggtcncgccgacggcccctggaacgaagggccttaggagtggagtggggtaattgggtttaagcgtaggagtaacgttgggtacgacccgtaataaagtttacgtacggaccgtaacggtaaggggttacggggttttaccgggggacgtaaaggggtcaagttaccgaaggttacgggaccccgggggtaactaccggttcccgaacgtcccggaacctaactaaacgttaccgaagtcggaaaccttcggaaccctagtaactacgacttacgttacggaaccgtaccgttacggttccgttactaattaccgtgtacggcgttaacaacgggaacggtaaccggg

SEQ ID NO: 433873 - DNA, 640 bp, Homo sapiens
  misc_feature: GZ8MTXP01CVAJA.51.12.B01.1.454.CMB.2.raw
  modified_base (95)..(95): a, c, t, g, unknown or other
  modified_base (145)..(145): a, c, t, g, unknown or other
  modified_base (229)..(229): a, c, t, g, unknown or other
  modified_base (267)..(267): a, c, t, g, unknown or other
  modified_base (280)..(280): a, c, t, g, unknown or other
  modified_base (292)..(292): a, c, t, g, unknown or other
  modified_base (315)..(315): a, c, t, g, unknown or other
  modified_base (407)..(407): a, c, t, g, unknown or other
tcagcgatcgtatacacgaccggtgctcgatttagtagtgtagattccgcgggcacgaccggtgctcgatttgtagtgtagattccgcgggggancatcacccagcaaccacatctgtcctctagagaacccctgagagccccgntcctcaccatggactggacctggagatcctcttcttggtggcagcagccacaagagcccactcccaggtgcaggtgtgcagtcngggctgaggtgaagacgcccgggctcgagtgaaggtcncctgcaagacctntgctacaccttnagtgacaacacgtcacgtggtcncgccaggccctaggacaagggtccttggagtggagtggggaattgggtttaacgcgtaggaagtaacgtgggtacgccgaactaaatttagngacgacggtaagggtacggtttacgggggactaggggtcagttacgaacgttacgggaacccggggataacccggtccgaagttacccgaccctaaaccgtaaactttacgaacgttacgggaaacctcgaacccgtaggtctaacggaacttacgttcggaaaccggtcaaccggggttccttaacttaagtttaccgtggtaccggacgaccgtaagggaacgggccgggg

SEQ ID NO: 433874 - DNA, 646 bp, Homo sapiens
  misc_feature: GZ8MTXP01B03DI.51.12.B01.1.454.CMB.2.raw
  modified_base (278)..(278): a, c, t, g, unknown or other
  modified_base (289)..(289): a, c, t, g, unknown or other
  modified_base (296)..(296): a, c, t, g, unknown or other
  modified_base (301)..(301): a, c, t, g, unknown or other
  modified_base (444)..(444): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcgaggtggtgcagtcgtggggctggaggtgaaggacggcccggggctcgagtgaaggtcnctgcaagcctnggctacnccttnagtgacaacacgtcagtggtgcgccgacggccctggacaagggtccttggaggtggagtggggtaattgggtttaagtctaggagtaacgtgggtcgacccgtataaattgtcggacgacgtagggtaagggtttccgggggntacggggtcagtacgaggtacgggaccccggggacaccggttccgaacgtacccggaccctaactaaaccgttacgaacgtagggtaaacctcggaaccgtacgttcgtacgacttacgtttcggaaccgtacgttacccggggttcttacttaagttacccgtggttaccggacggttaacgaacgggaacgggcccgggg

SEQ ID NO: 433875 - DNA, 602 bp, Homo sapiens
  misc_feature: GZ8MTXP01DKDS7.51.12.B01.1.454.CMB.2.raw
  modified_base (270)..(270): a, c, t, g, unknown or other
  modified_base (282)..(282): a, c, t, g, unknown or other
  modified_base (294)..(294): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagaagcccggggctcagtgagtcnctgcaagcctcnggctacaccttnagtggacaacaacgtccacgtgggtcgcgccgaggcccctggacaagggtccttggagtggaatggggaaacttgggtttaacgtctagggaagtaacgtggggtacgacccgataaaatttgaggctacgagggtacggtttcgggggactaggggtcagttcgaagtcgggaacccgggggtacacggttccaagtcccgaccaaactaaacttacagtacggaacctggacctagtctagactgttcgaaccgtacgacgggttccttacgttaattcgtgcgtacgacaagggaacgaaccggg

SEQ ID NO: 433876 - DNA, 865 bp, Homo sapiens
  misc_feature: GZ8MTXP01BVS2L.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtgtgcagtcgtgggctgaggtgaagacggcccgggctcgagtgaggtctcgtgacaagtaccctgtcggacctactacctttcgaggtcggaccaaaccgtaccgtccacggttcgggggtcgcccgccgacggtcccccgtaggggaaccgaaacgggggtcccttagggaaagggttggggaaagtttgggggtaaacgttttaggggttttaacggcgtaaggggtaaacgtaacccggttggggtacggaccccgggtaaattaaaagtttacgtcgggaaccgtaacggggttaaggggttacgggggtttttacccgggggacgtaacgggggttaccctaagtaccggtaacgggttacggggaaacccccggggggtactaaaccccgggttcccgtaaaccggttacccggaaaccccgtaaaaccctaaaccgttttaaacgaacggggtttaaccggtaaacccgtttacgggaaaccccggttaaggttaacccgttaagggttaaccttaacggttttaacccgggaaaccgtaaccccggttacccggggttaccctttaccggtttaaatttccccggttgggtaaccggtaccggaaaccgtaacggggttaaaccgggcccggggg

SEQ ID NO: 433877 - DNA, 594 bp, Homo sapiens
  misc_feature: GZ8MTXP01C9TJC.51.12.B01.1.454.CMB.2.raw
  modified_base (259)..(259): a, c, t, g, unknown or other
  modified_base (269)..(269): a, c, t, g, unknown or other
  modified_base (280)..(280): a, c, t, g, unknown or other
  modified_base (287)..(287): a, c, t, g, unknown or other
  modified_base (291)..(291): a, c, t, g, unknown or other
  modified_base (310)..(310): a, c, t, g, unknown or other
  modified_base (377)..(377): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagacgcccgggctnagtgaagtcnctgcaagctcnggctacncttnagtgcaacacgtcagtggncgcagccctgacaggtctggagtggatggattggttaagctaggagaacgtggtgccgtataaattngacgacgagggttacggtttacgggggactagggtcctagtacgagtacgggacccggggactaccggtcacgtcgaccaactaacttacgaatcggaacttcggacctacggttctaggttactacgtttacggaaaccgtcgacccggggttcccttacgttaacgtttacccgtgggttaccgaccggaacgaacgggttaaacggcccggggg

SEQ ID NO: 433878 - DNA, 637 bp, Homo sapiens
  misc_feature: GZ8MTXP01D1L07.51.12.B01.1.454.CMB.2.raw
  modified_base (279)..(279): a, c, t, g, unknown or other
  modified_base (281)..(281): a, c, t, g, unknown or other
  modified_base (291)..(291): a, c, t, g, unknown or other
  modified_base (297)..(297): a, c, t, g, unknown or other
  modified_base (300)..(300): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgcccccgctcctcaccatggactggacctggagatcctcttcttggtgcagcagccacaagacgcccactcccaggtgcgaggtggtgcagtcgtggggctggaggtagaagacggcccggggctcgagtgaacgtcncngacagcctgngctacnctnagtgacaacacgtcagtggcgcgcgacggccctaggacgaggtctggagtggagtgggtaaagttggttcgtcgtaggaacgtaacgtgggtacgaccgtaataaagttgtacggacgtaacggttaggggttaacgggtttaccgggggacgttacgggtaccagtacgaggtaccggggaccgggactaccgtacgaccgtaccgacctaaacgttaaccgtagtacggtacgtaacgtcgacgtgtaacgtaagttacgttacgttaaggaaccgtaccgttaccggttcttactaacgttacgcggtacggacgacgtaagggcggtaaccgg

SEQ ID NO: 433879 - DNA, 545 bp, Homo sapiens
  misc_feature: GZ8MTXP01DWPEW.51.12.B01.1.454.CMB.2.raw
  modified_base (270)..(270): a, c, t, g, unknown or other
  modified_base (281)..(281): a, c, t, g, unknown or other
  modified_base (288)..(288): a, c, t, g, unknown or other
  modified_base (314)..(314): a, c, t, g, unknown or other
  modified_base (368)..(368): a, c, t, g, unknown or other
  modified_base (372)..(372): a, c, t, g, unknown or other
  modified_base (378)..(378): a, c, t, g, unknown or other
  modified_base (482)..(482): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttctggtggcagcagccacaagacgcccactcccaggtgcaggtggtgcagtctggggctgaggtgaagacgcccgggctcagtgaagtcnctgcaagcctntgctacncttcagtgcaacaacgtccatgggtncgccgacgccctggacaggtctgagtggatgggaattggttgctgagactggcncganaaattngcacgagggtgtttcggggatagggtcagtcgagtcggacggggactacggtcaacgccgaccaactaacttacgaacgtcggaacctgaaccgtagtcctaanactagttacgacgtcgcggttcgttacttaagtacgtgtcgacgttacgaaggttaacggcgg

SEQ ID NO: 433880 - DNA, 668 bp, Homo sapiens
  misc_feature: GZ8MTXP01C6WMY.51.12.B01.1.454.CMB.2.raw
  modified_base (304)..(304): a, c, t, g, unknown or other
  modified_base (309)..(309): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgccccactcccaggtgcaggtggtgcagtcgtggggctggaggtgaaaggacggccccggggctcgagtgaaggtctcctgacaagacctctggctacnccttnagtcggacaacaacgtccagtgggtcgccgccgacggcccctaggacaaggggtccttggaggtggagtggggtaattgggtttaagtcgtagggaagtaacgtggggtacgccgtaactaaagtttagtcggacgtacggtagggttacgggtttcgggggacgtaaggggtcacgtcgaaggtacggggaccccggggtaactaccggttaccagtcccgaccctaaaccgtaacttacgaacgtacggtaaacctcggaacctacggttaacctagaacgttacgttacggaaacccgtacgttaacccggttccgttacttaagttacgtgtcgacgttacgaaggaacgccggg

SEQ ID NO: 433881 - DNA, 589 bp, Homo sapiens
  misc_feature: GZ8MTXP01BJ12D.51.12.B01.1.454.CMB.2.raw
  modified_base (275)..(275): a, c, t, g, unknown or other
  modified_base (509)..(509): a, c, t, g, unknown or other
  modified_base (522)..(522): a, c, t, g, unknown or other
  modified_base (576)..(576): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttctggtggcagcagccacaagacgccccactcccaggtgcaggtggtgcagtcgtggggctggaggtgaaggacgcccggggctcgagtgaggtcnctgacagctgtgctaccacttcgagtcggacaaacgaaccgtccacgtggggtcgccgccgaccggcccctaggaacaagggtccttaggagtggagtgggtaatttgggttaagtcgtaggacgtacgtgggtcgccgtaataaagttgcggacgtaggtagggtaggtttacgggggctagggtccagtcaggtacgggaccgggactacgtccacgtccgacactacgtanacgtgactgaccngtcgtagattagttcgacgacgttacgttccgttataatcgtgtcaccggttancggttaagccggg

SEQ ID NO: 433882 - DNA, 609 bp, Homo sapiens
  misc_feature: GZ8MTXP01AV77G.51.12.B01.1.454.CMB.2.raw
  modified_base (263)..(263): a, c, t, g, unknown or other
  modified_base (272)..(272): a, c, t, g, unknown or other
  modified_base (274)..(274): a, c, t, g, unknown or other
  modified_base (281)..(281): a, c, t, g, unknown or other
  modified_base (287)..(287): a, c, t, g, unknown or other
  modified_base (310)..(310): a, c, t, g, unknown or other
  modified_base (353)..(353): a, c, t, g, unknown or other
  modified_base (387)..(387): a, c, t, g, unknown or other
  modified_base (596)..(596): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtccctctagagaacccccctgagagcccccgctcctcaccatggactggacctggaggatcctcttcttggtggcagcagccacaagacgcccactcccaggtgcaggtggtgcagtctggggctgaggtgaagacgcccgggctnagtgagtcncngcagctngctacnctcagtcgacaacacgtcatggncgccgagccctggacaggcctgagtgatgggtaattgggtttnctagggatacgtgggtcgaccgtactaaagtttnggacctaacggaggggttacgggtttcgggggacctaagggggttcaacgtccgtaaggtcggggaaccccggggtacgaccggttccaacggttcccgacccaaacgtaacctttacgaggttcgggaaactcgaacccgtggtcctggaacctagtttccggaaccggtaaccgcggttccgttacttaacgttctggtcgaccganaaggaaccgcggg

SEQ ID NO: 433883 - DNA, 630 bp, Homo sapiens
  misc_feature: GZ8MTXP01ALA6W.51.12.B01.1.454.CMB.2.raw
  modified_base (273)..(273): a, c, t, g, unknown or other
  modified_base (284)..(284): a, c, t, g, unknown or other
  modified_base (290)..(290): a, c, t, g, unknown or other
  modified_base (407)..(407): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctggaggtgaagacgcccggggctcagtgaggtcnctgcaagcctngctacncttcagtggacaacacgtccagtgggtgccgccgacggcccctggaccgaaggtccttggagtggagtgggaattgggttaagcgtaggagtaacgtgggtcgacctataaatttgngacgacgtagggtcggtttcgggggagtagggtcagttccgaaggttaccgggaccggggactaccggttaccacgttacccggaccctaaacgtaacccttacgaagttacggaaacgttacgaccaggttaacctgaaccttcggtttaaaccggaccgtaaccgttaccgggttccttacttaattaccgtggtacgcgttaaccgaaggaacggccggg

SEQ ID NO: 433884 - DNA, 769 bp, Homo sapiens
  misc_feature: GZ8MTXP01CC2H6.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccaacaagacgccccactcccgaggtgcagggtggtgcagtcgtggggctggaggtagaacggacggcccggggctcgaggtgaacggtctcgtgacaacgtcctcgtcggactaccaccttcgaggtcgaccaaacgaccgtcacggtgggtcgccgccgacggcccctagggaaccgaagggtccttaggaggtggtagtggggtaacgttgggtttaagtcgtagggaacgtaacggtgggtacgacgtaacgttaaagtttgtacggaccgtaacgggtaacgggggttacggggtttaccgggggacgttacggggtaccaacggttaccgacgggttaaccgggggaaaccccggggtaccgtaaaccggttcccgaaccgttaccccggaacctaaacccgttaaaccttacggtaaacgtaacgggtaacctacggaaaccgtcgttaacgtaaggttaccgttaaacgtttacgggaaacccgtaccggttaaccgggttccgttaacctttaaggttacgttcggaccggaaccggacgaaacgggttaacggggaaccgggg

SEQ ID NO: 433885 - DNA, 699 bp, Homo sapiens
  misc_feature: GZ8MTXP01B6XQU.51.12.B01.1.454.CMB.2.raw
  modified_base (277)..(277): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgcccactcccaggtgcaggtggtgcagtcgtggggctgaggtgaagacggcccggggctcgagtgaaggtcncctgcaagcctctggctacaccttcaggtcggacaaacaacgtccacgtggggtcgccgccgacggccccctagggacaaggggtccttaggaggtgggagtgggggtaaatttgggtttaagtcgtagggaggtaaccgttggggtacgacccggtaactaaaagtttgtacggactaacggtaggggtacggggttttcgggggactaggggtacagttcgaaggttacgggaacccggggactaacccggttccgaacgtcccgaaccaacctaaccgtttacgacgtacggtaaacctcggaacctaaggttctacggacttacgtttacggaacccggtaccgaaccggggttcccttacgttaacgtttccgtggtaccgggaccgttacggtaacggggaaccgggtcccggggg

SEQ ID NO: 433886 - DNA, 542 bp, Homo sapiens
  misc_feature: GZ8MTXP01B3RWF.51.12.B01.1.454.CMB.2.raw
  modified_base (269)..(269): a, c, t, g, unknown or other
  modified_base (271)..(271): a, c, t, g, unknown or other
  modified_base (278)..(278): a, c, t, g, unknown or other
  modified_base (289)..(289): a, c, t, g, unknown or other
  modified_base (378)..(378): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaggtcncngcagctngctacaccttnagtgcaacacgtccacgtggtgcgccaggcccctggacagggccttggagtggatggaattggttgctgagactggtcgcgactaattngcacgagggtaggtttcgggggctaggggtcagtcgagtcgggacccggggacacggtccatccgaccactaacttacagtcggaactgaccaggtcctgactagttgaccgtcaccgggttccttactaattcgtgtcggacgttacgaaggaacggccgggg

SEQ ID NO: 433887 - DNA, 592 bp, Homo sapiens
  misc_feature: GZ8MTXP01DGQUZ.51.12.B01.1.454.CMB.2.raw
  modified_base (280)..(280): a, c, t, g, unknown or other
  modified_base (307)..(307): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgcccccgctcctcaccatggactggacctggaggatcctcttcttggtgcagcagccacaagacgcccactcccaggtgcaggtggtgcagtcgtggggctggaggtgaaaggacggcccggggctcaggtgaaggtcncctgcaagcctcgtggcctacaccttnaggtcggacaacaacgtcacgtgggtcgcgccgacggcccctaggacaggggtccttggagtggatggggaattcgggtttaagcgtggagtaacgtgggtacgacgactaaatttgcgcgacgtagggtaggtttcggggactagggtcagtcgagtacggacccggggactacggtccaagtccgaccaacaacgttcgaagtcgaactcgaccgtgtctgactagttcgaacgtcgacggttcttacttaagttacgtgtacgacgacgaagaacggccggg

SEQ ID NO: 433888 - DNA, 761 bp, Homo sapiens
  misc_feature: GZ8MTXP01EQLLQ.51.12.B01.1.454.CMB.2.raw
  modified_base (278)..(278): a, c, t, g, unknown or other
  modified_base (290)..(290): a, c, t, g, unknown or other
  modified_base (302)..(302): a, c, t, g, unknown or other
  modified_base (327)..(327): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggagatcctcttcttggtggcagcagccacaagacgcccactcccaggtgcaggtggtgcagtcgtggggctggaggtagaagacggcccggggctcgagtgaaggtcnctgcaagacctnggctacaccttnagtgacaacacgtccacgtgggtcnccgccgacggcccctggaccgaagggtccttggagtggagtggggtaattgggtttaagctggacgtaaacgttggggtacgaccgaactaaaatttagtaggtaccgaacggtaaggggttaacgggttttaccggggggacgttaacgggggtaccctaaggttacccgaaaggtttacccgggggaaaccccggggggtaacctaacccgggtttaccccgaaaccgttaccccgggaaaccccgtaaaccgtaaaacccttttaaccgaaacgtttaaccggggaaaccttaccgggaaaccctaaggttaaccgtaacgttaacccgtaagttttaccggaaccgtaaccgttaacccggggttccctttacgttaacgtttaaccgtgggttacgaccggttaacgtaacggaaacgggtcccggggg

SEQ ID NO: 433889 - DNA, 642 bp, Homo sapiens
  misc_feature: GZ8MTXP01DK6ZB.51.12.B01.1.454.CMB.2.raw
  modified_base (279)..(279): a, c, t, g, unknown or other
  modified_base (619)..(619): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgccccactcccaggtgcaggtggtgcagtcgtggggctggaggtgaagacggcccggggctcgagtgaaggtcncctgcaagacctgtcggacctactaccttgagtcgacaaacacgtccacgtgggtcgcgccgacggcccctaggacgaagggtccttaggaggtggagtggggtaattgggtttaagctaggaagtaacgtgggtacgaccgtaataaatttcgaggaccgtaggtacggggttaacgggttttccggggggacgggttacaacgttcgaacggtacgggacccggggtaacaccgggttccaacgtaccgacctaaacgtaacttacgagtaacggaactgaacctcgtgtaacgtacttagttacgaccgtacggtacggttccttattacttaacgngtgacgacagggaacgcggaacg

SEQ ID NO: 433890 - DNA, 579 bp, Homo sapiens
  misc_feature: GZ8MTXP01BCPJL.51.12.B01.1.454.CMB.2.raw
  modified_base (275)..(275): a, c, t, g, unknown or other
  modified_base (300)..(300): a, c, t, g, unknown or other
  modified_base (537)..(537): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagcccccgctcctcaccatggactggacctggaggatcctcttcttggtggcagcagccacaagacgccccactcccaggtgcaggtggtgcagtcgtggggctggaggtgaagagcccggggctcagtgaaggtcnctgcaagcctcgtggctacaccttnagtcgacaacacgtccacgtgggtcgcgccaggcccctggacagggtccttggagtggatggggaattgggtttaagcgtaggacgtacgtgggtcgccgtaataaattagtcgacgtacgagggtacggtttcgggggacgtaggggtcacgttcgagtacgggaccgggacgtacgtccacgtccgaccacgtaactacgagtcgtaactgaccagtctgactagttgacgtacncggttccttataattacgtgtcgacgactaaggaacgccggg

SEQ ID NO: 433891 - DNA, 667 bp, Homo sapiens
  misc_feature: GZ8MTXP01BSOS2.51.12.B01.1.454.CMB.2.raw
  modified_base (274)..(274): a, c, t, g, unknown or other
  modified_base (287)..(287): a, c, t, g, unknown or other
  modified_base (295)..(295): a, c, t, g, unknown or other
  modified_base (327)..(327): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctgaggtgaagaacgcccggggctcagtgaaggtcncctgcaagacctntggctacnccttcagtggacaacaacgtccacgtgggtcncgccaggccccctggaccagggccttggagtggatggggaaattgggtttaagcgtgagtaacgtggtcgccgacgtaattatgacgacgtaggtaggtttacggggtcgtagggtacgagtacgtacgtacggaccggggacgggtacgtaccgtacgtaccggtacccgaaccgtaccttaaaaaaaaccgtcgtaacggtaaaccgttacggaacccgtacgtaaccgttacggactaacgtttacggtaaccggtaaccgaccgggttcccgttaccggttaactttaaccgttaaggttcggacggttaccgtaacggaacgggtaacccggggg

SEQ ID NO: 433892 - DNA, 685 bp, Homo sapiens
  misc_feature: GZ8MTXP01EZG9D.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgcccactcccgaggtgcgaggtggtgcagtcgtggggctggaggtgaagacggcccggggctcgagtgaaggtctcctgcaacgacctcgtggctaccaccttcgagtcggacaacgaacgtccacgtggggtcgccggaccgacggcccctgggaaccgtaagggggccttagggaggttgggagtagggggtaaatttgggttttaaggtcgtagggaacggtaaccgtggggtacgaccccggtaataaaagtttgcgaccgtaggaggggttacgggtttacgggggacgtaggggtccagttcgaaggttacggggaacccggggactaccgtacccgtagtacccgacctaacgtaaacgttacgaggtacggtaaactcggaaccgttaagtcgtagacgttacgtttacgaaccggtaaccgacgggttccttactaattacgtgacgacgacgtaacggaacggtccgggg

SEQ ID NO: 433893 - DNA, 651 bp, Homo sapiens
  misc_feature: GZ8MTXP01B4M6F.51.12.B01.1.454.CMB.2.raw
  modified_base (95)..(95): a, c, t, g, unknown or other
  modified_base (281)..(281): a, c, t, g, unknown or other
  modified_base (291)..(291): a, c, t, g, unknown or other
  modified_base (298)..(298): a, c, t, g, unknown or other
  modified_base (302)..(302): a, c, t, g, unknown or other
tcagcgatcgtatacacgaccggtgctcgatttagtagtgtagattccgcgggcacgaccggtgctcgatttgtagtgtagattccgcgggggancatcacccagcaaccacatctgtcctctagacgaaccccctgagacgcccccgctcctcaccatggactggacctggaggatcctcttcttggtggcagcagccacaagacgccccactcccaggtgcaggtggtgcagtcgtggggctggaggtagaaggacggccccggggctcgagtgagtcnctgcagcctntgctacncttnagtcgacaacacgtcacgtgggtcgccgccgacggcccctaggacgaagggtccttggaggtggagtggggtaattgggtttaagtcgtaggaacgtacgtggggtacgacccgtaataaatttagaggacgacggtaaggggttacgggtttacgggggactaaggggtcaagttcgaacggtcggggaaccccggggtaacaccggtaccacgtcccgaccctaaactaaacgtttacgaacgtacggaaccttcggaaccctaggtcctgaaccttagttaccggacgaaccgttacccggttccttacgtaattaccgtggtacgcgacgaacggaacggccggg

SEQ ID NO: 433894 - DNA, 685 bp, Homo sapiens
  misc_feature: GZ8MTXP01EB6R1.51.12.B01.1.454.CMB.2.raw
  modified_base (281)..(281): a, c, t, g, unknown or other
  modified_base (293)..(293): a, c, t, g, unknown or other
  modified_base (300)..(300): a, c, t, g, unknown or other
  modified_base (325)..(325): a, c, t, g, unknown or other
  modified_base (376)..(376): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaacccccctgagacgccccgctcctcaccatggactggacctggaggatcctcttcttggtggcagcagccacaagacgccccactcccaggtgcagggtggtgcagtcgtgggggctggaggtgaagacgcccggggctcgagtgaaggtcnctgcaagacctnggctacnccttcagtgcaacacgtcagtggcncgccaggcccctggacaagggccttggagtggagtgggaattgggtttaancgtggagtacgtgggtacgccgtataaattagtgacgacgtagggtacgggtttacgggggacgtagggtaccagtaccgaaggtcgggaacccgggggaaccgtaccggtacctactacccggaccctaaacctaaacctttaaccgaaacgttacgggaaaccgttcgaacccgtaacggtccgttacgttaaccgttaagttttacgggaacccggtaaccgttaacccgggttccccggtttacgtttaacttaaccggttggttacggaccggaaccgtaaagggaaaccgggtaacccggggg

SEQ ID NO: 433895 - DNA, 673 bp, Homo sapiens
  misc_feature: GZ8MTXP01C56FO.51.12.B01.1.454.CMB.2.raw
  modified_base (283)..(283): a, c, t, g, unknown or other
  modified_base (312)..(312): a, c, t, g, unknown or other
  modified_base (438)..(438): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccaacaagacgccccactcccaggtgcagggtggtgcagtcgtggggctggaggtgaaggaacggccccggggctcgagtgaaggtcncctgacaagacctcgtggctactaccttnagtcgacaacacgtccacgtggtcgcgccgacggcccctggacaggggtccttaggaggtggagtggggtaattgggtttaagtcgtaggaaggtaacgtggggtacgacccgactaaaagtttancggaccgaaggtaggggttacggggtttcgggggacgtaggggtcagtacgaacggtacggggaaccccggggactaacccggttccaacgttcccgaaccctaaaccgtaaaccgttacgacgtacggtaaacctcggaaccctaggtccgtagaccttagttcggaaaccgtaccgacccggggttccttacgttaatacgttggtcgacgaacgaagggaaccggaacgggg

SEQ ID NO: 433896 - DNA, 722 bp, Homo sapiens
  misc_feature: GZ8MTXP01DCVC7.51.12.B01.1.454.CMB.2.raw
  modified_base (272)..(272): a, c, t, g, unknown or other
  modified_base (274)..(274): a, c, t, g, unknown or other
  modified_base (284)..(284): a, c, t, g, unknown or other
  modified_base (297)..(297): a, c, t, g, unknown or other
  modified_base (415)..(415): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggagatcctcttcttggtggcagcagccacagacgcccactcccaggtgcgaggtggtgcagtcgtggggctgaggtgaagacggcccgggctcagtgagtcncngcaagacctntcgctacaccttnagtcgacaacaacgtccacgtgggtcgccgccgacggccccgtaggacaagggtccttggagtggagtgggtaattgggtttgcgtggaagtaacgtgggtacgaccgataaattagnggacacggtagggttacgggtttcggggacgtaggggtacacgttacgtaaggtaccggggaacccggggtacggtacccgttacccgtaacgttacccggaacccctaaaccgttaaaccgtttaaccgaacggttaacggggtaaaccctttacgggaaccccgttaaggttccgtaacgggttaaaccctttaaaggtttaaccgggaaacccggtacccggttaaacccggggttcccgttaaccttttaaagttacccggtggtaccggaccgaaccggtaaggaaccgggtaacccggggg

SEQ ID NO: 433897 - DNA, 598 bp, Homo sapiens
  misc_feature: GZ8MTXP01AUCOK.51.12.B01.1.454.CMB.2.raw
  modified_base (281)..(281): a, c, t, g, unknown or other
  modified_base (283)..(283): a, c, t, g, unknown or other
  modified_base (298)..(298): a, c, t, g, unknown or other
  modified_base (327)..(327): a, c, t, g, unknown or other
  modified_base (377)..(377): a, c, t, g, unknown or other
  modified_base (407)..(407): a, c, t, g, unknown or other
  modified_base (592)..(592): a, c, t, g, unknown or other
tcagcgatcgtatacacgaccggtgctcgatttagtagtgtagattccgcgggcacgaccggtgctcgatttgtagtgtagattccggcgggggagcatcacccagcaaccacatctgtcctctagacgaaccccctgagagccccgctcctcaccatggactggacctggagatcctcttcttggtggcagcagccacaagacgccccactcccgaggtgcgaggtggtgcaggtcgtggggctggaggtgaaggacggcccggggctcgagtgaggtcncngcagctcgtgctacnccttcgagtcgacaacacgtcacgtggcncgccacggcccaggacgaggtcctaggagtggagtggaattggtttaagngtagagacgtggtacgacgtaactaattgnggacgtaggagggtaggtttacggggactagggtcaacgtcgaggtacgggacccggggactacggtaccgacgtaccgacgaacctaaacgttaccgagttacggaaaccgttcggaaaccgtgtccgtaagaccgtagttacggacgtacgaccggttcttactaatacgtgcgcgacgaagnggccgg

SEQ ID NO: 433898 - DNA, 673 bp, Homo sapiens
  misc_feature: GZ8MTXP01BJH0Y.51.12.B01.1.454.CMB.2.raw
  modified_base (477)..(477): a, c, t, g, unknown or other
  modified_base (662)..(662): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgcccccgctcctcaccatggactggacctggaggatcctcttcgttggtggcagcagccaacaagacgccccactcccgagggtgcgtagggtggtgcgtaggtcggtgggggctagggagggtaggaaacgggaaccgggccccgggggtcctacggaggtacggaacggttccctccgtagaccgtaacgtacccgtcgtcggacctacctacctgaggtcgacaacgacgtcacggtggtcgccgccgaccggcccgtaggacgagggtccttaggaggtggagtgggtaagttcggtttgcgtaggaacgtacgtggcgacgtaataagttncgacgtaggagggttggttcgggctaggcagtcgaggtccgggaccggactacggtcacgtcccgacgtaaactacgtacacggtacgaacgttacgactacgtcgtacggacttacgttaccggaaacccgtaaccgccgggttccttaacttaagttacgtggaaccggcggaacggaacggngggaacccggg

SEQ ID NO: 433899 - DNA, 531 bp, Homo sapiens
  misc_feature: GZ8MTXP01BHO3O.51.12.B01.1.454.CMB.2.raw
  modified_base (274)..(274): a, c, t, g, unknown or other
  modified_base (276)..(276): a, c, t, g, unknown or other
  modified_base (283)..(283): a, c, t, g, unknown or other
  modified_base (294)..(294): a, c, t, g, unknown or other
  modified_base (317)..(317): a, c, t, g, unknown or other
  modified_base (384)..(384): a, c, t, g, unknown or other
  modified_base (511)..(511): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgcccactcccaggtgcaggtggtgcagtcgtggggctggaggtgaagacggcccgggctcgagtgagtcncngcagctntgctacacttnagtcgacaacacgtcacgtggcncgccagccctaggacgaggtcttgagtggatgggaattggttgctggagacgtggcgccgataaatngactagagggtcgttcggggctagggtcagtcgagtcggaccgggactcgtcactcgaccaactacttagagtggtaactcgacctggtctagactagttcgaacgcaccggttcttactaagttgnggtgcgacgaagaacgggcg

SEQ ID NO: 433900 - DNA, 678 bp, Homo sapiens
  misc_feature: GZ8MTXP01AM2PH.51.12.B01.1.454.CMB.2.raw
  modified_base (273)..(273): a, c, t, g, unknown or other
  modified_base (275)..(275): a, c, t, g, unknown or other
  modified_base (319)..(319): a, c, t, g, unknown or other
  modified_base (413)..(413): a, c, t, g, unknown or other
  modified_base (629)..(629): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaacccccctgagagcccccgctcctcaccatggactggacctggaggatcctcttcttggtggcagcagccacaagacgccccactcccaggtgcaggtgtgcagtctggggctgaggtgaagacgcccgggcccaggtgaggtcncngcaagcctctgctacacttcagtgacaacacgtcacgtgggtcnccgccacggcccctaggacaagggcttcggaggtggagtggggacttgggtttaagcgtaggacgtaacgttgggtgacccggataaaagtttntaggacgaacgtaggggttacggtttcgggggactaagggggttcaagttccgagttcggggaacccggggtactaccgggggttcaacgttccggacccctaaactaaaccgtttacgaacgttaacgggtaaacccttcggaaaccccgtaagttccctaagggtaacccttaggtttaccggaacccggttaacccgcggggttccccgtttnttaacgtttaaccgtggtaaccgacgacgaggtaacggccgggtaacgg

SEQ ID NO: 433901 - DNA, 638 bp, Homo sapiens
  misc_feature: GZ8MTXP01BHXN6.51.12.B01.1.454.CMB.2.raw
  modified_base (95)..(95): a, c, t, g, unknown or other
  modified_base (282)..(282): a, c, t, g, unknown or other
  modified_base (294)..(294): a, c, t, g, unknown or other
  modified_base (300)..(300): a, c, t, g, unknown or other
  modified_base (304)..(304): a, c, t, g, unknown or other
  modified_base (325)..(325): a, c, t, g, unknown or other
tcagcgatcgtatacacgaccggtgctcgatttagtagtgtagattccgcgggcacgaccggtgctcgatttgtagtgtagattccgcgggggancatcacccagcaaccacatctgtcctctagacgaaccccctgagacgcccccgctcctcaccatggactggacctggagatcctcttcttggtggcagcagccaacaagacgccccactcccaggtgcgaggtggtgcagtcgtggggctggaggtagaagacggccccggggctcgagtgacgtcnctgacagcctgngctacncttnagtgcaacacgtcacgtggcncgccgacgcccgtggacgaggtccttggaggtggtagtgggtaattgggtttgtcgtaggaacgtaacgtcgggtacgacccgtaataaagttagcggacgacggtaggggttacgggtttaccggggacgtaagggtacctagtacgacggtaccgggaacccggggaactaccggttacccgacgtacccgaccaacgttaacctacgtacgtacgtacgtacgacctagtctagttagttacgttcggaaccgtaccgaccggttcgttacttaattcgtggtcgaccgaagtaacggaacggaaccggg

SEQ ID NO: 433902 - DNA, 659 bp, Homo sapiens
  misc_feature: GZ8MTXP01BABSG.51.12.B01.1.454.CMB.2.raw
  modified_base (275)..(275): a, c, t, g, unknown or other
  modified_base (299)..(299): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcgaggtggtgcagtctggggctggaggtgaagacggcccggggctcgagtgaaggtcnctgcaagcctctggctacaccttnagtggcaacacgtcacgtgggtcgcgccacggcccctaggacgaaggccttggagtggagtgggaattgggtttgctaggagtaacgtgggtcgaccgtactaaattgtcgacgtaacggtaaggggttagggttttaccgggggacgtacggggttcaagttcgaaggtacggggacccgggggactacggtccgacgtacccggacctaaaccgtaaccgtttacgaagttacggtaaaccgttacgaaccacggtcgtacgaacgttacgtttacggaccggtaaccgaccggggttccttacgttaacgttacgtcgggttcggaccggaacgaacggttaacgggtaacccgggg

SEQ ID NO: 433903 - DNA, 719 bp, Homo sapiens
  misc_feature: GZ8MTXP01BVNG5.51.12.B01.1.454.CMB.2.raw
  modified_base (337)..(337): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgcccccgctcctcaccatggactggacctggagatcctcttcttggtggcagcagccacaagacgcccactcccaggtgcaggtggtgcagtcgtggggctggaggtgaaggacggccccggggctcaggtgaaggtctccgtgacaagccctcgtggcctacaccttcagtcggacaacaccgtccacgtgggtcnccgccaggccccctaggaccaagggtccttggagtgagtggggtaaattgggtttaacgcgtagacgtaacgtggggtacaccgtactaaatttcgaggacgtacggaaggggttacggttttaccgggggacgtaaggggttaccaacgttccgtaaaggttccgggaaaccccgggggtactaccggttacccgaacgttccccggaaccctaaccgtaaaccttttacgaacgtttacggaaaccgtacggtaaccctaaaggttccgttacgttaccgttaacgttttaaccggaaccgtaaccggttaaccggttcccgttagttaaccgttttacgtcggttacgaccggttaacgaacggttaacgggtcccggg

SEQ ID NO: 433904 - DNA, 727 bp, Homo sapiens
  misc_feature: GZ8MTXP01CU34E.51.12.B01.1.454.CMB.2.raw
  modified_base (278)..(278): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaacccctgagacgccccgctcctcaccatggactggacctggaggatcctcttctggtggcagcagccacaagacgcccactcccaggtgcaggtggtgcagtcgtggggctggaggtgaaggacggcccggggctcgagtgaacggtcnccgtgacaagcctcgtggacctacaccttcgagtcgaccaacaaccgtccacgtgggtcgccgaccgacggccccgtaggaacgaagggtccttaggaggtggtagtggggaattgggtttaagcgtaggaacgtacgtgggtacgaccgtaataaattgcggacgaacggtagggttacgggtttacgggggactaggggtacagttacgaaggtaccggggaacccggggacctaaccggttacccgaacgttacccggaaccctaaacctaaaccgtttaaccgaacggttacggtaaaccgttaccggaaaccccgttaagggttaacctaacgttaaaccgttacgtttaccgggaaacccggtaacccgttaacccgggttccgttacgtttaacgttaacggttcggtacgacggaaccgtaagggaaccgggtaaccgggg

SEQ ID NO: 433905 - DNA, 604 bp, Homo sapiens
  misc_feature: GZ8MTXP01D9FGD.51.12.B01.1.454.CMB.2.raw
  modified_base (280)..(280): a, c, t, g, unknown or other
  modified_base (293)..(293): a, c, t, g, unknown or other
  modified_base (301)..(301): a, c, t, g, unknown or other
  modified_base (331)..(331): a, c, t, g, unknown or other
  modified_base (427)..(427): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcaggtggtgcagtcgtggggctggaggtgaaaggaacggcccggggctcgagtgaaggtcncctgcaagacctntgactacncttcagtgacaacgaacgtcacgtgggtcncgccgacggcccctaggacgaagggtccttaggagtggagtggggtaattaggtttgcttaggaacgtaacgttgggtacgaccgaataaatttgngacgagtagggtaaggtttccggggagagggtcagtacgacgtacggaacccggggacacgtaccgtacgtccgaccaaacgtaacttacgacgtaggaactagaccaggtctagactagttacgaaccgacgacggttccttatgttacgtgtacgacgagtaacgaacggccggg

SEQ ID NO: 433906 - DNA, 597 bp, Homo sapiens
  misc_feature: GZ8MTXP01EGK54.51.12.B01.1.454.CMB.2.raw
  modified_base (275)..(275): a, c, t, g, unknown or other
  modified_base (285)..(285): a, c, t, g, unknown or other
  modified_base (291)..(291): a, c, t, g, unknown or other
  modified_base (315)..(315): a, c, t, g, unknown or other
  modified_base (371)..(371): a, c, t, g, unknown or other
  modified_base (378)..(378): a, c, t, g, unknown or other
  modified_base (384)..(384): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggagatcctcttcttggtggcagcagccaacaagacgcccactcccaggtgcaggtggtgcagtcgtggggctggaggtgaagacggcccgggctgagtgaggtcnctgcagcctngctacncttcagtgcaacacgtccagtggnccgcgagccccaggacgaggcttgagtgatggaattggttaagctagagacgtggngcctaanaaattngcagtagggtagtttacgggctagggtcagtcacgtacgggaccgggaccacgtccgaatcccgaacaactaacttacgacgttaggaaactcgaaacctcgtaacgtacggttattacgtttaccggaaacggtaaccgttaccggggttcccttaacttaaccgttaacgttggtaccggaacgaccgttaagggaacgggaacccggggg

SEQ ID NO: 433907 - DNA, 649 bp, Homo sapiens
  misc_feature: GZ8MTXP01EWFX7.51.12.B01.1.454.CMB.2.raw
  modified_base (283)..(283): a, c, t, g, unknown or other
  modified_base (286)..(286): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaacccccctgagacgccccgctcctcaccatggactggacctggaggatcctcttcttggtggcagcagccacaagacgccccactcccaggtgcgagggtggtgcagtcgtggggctggaggtagaaggacggcccggggctcgagtgaagtcnccngacaacgacctgcggcctactaccttcgagtcgacaacgacgtccaggtggtcgccgaccgacggccccgtaggactagggccttggaggtgggtagtggggtaattgggtttaagtcgtaggacgtacgtgggtcgaccgtataaagttacgtagacgacgtagggttacgggtttaccgggggactacggggtacaacgttcgaggtacgggaaccggggtacacgtaccgtacgccgaccaactaacgtagacgtacggtaacctacggacctaggtctacgttacgtacgtttacggaaccgtaccggacgttccgttacttaacgttcgtgtcggaccgaggaacggaaggaaccggg

SEQ ID NO: 433908 - DNA, 631 bp, Homo sapiens
  misc_feature: GZ8MTXP01DSFAZ.51.12.B01.1.454.CMB.2.raw
  modified_base (280)..(280): a, c, t, g, unknown or other
  modified_base (283)..(283): a, c, t, g, unknown or other
  modified_base (293)..(293): a, c, t, g, unknown or other
  modified_base (300)..(300): a, c, t, g, unknown or other
  modified_base (305)..(305): a, c, t, g, unknown or other
  modified_base (329)..(329): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaacccccctgagacgcccccgctcctcaccatggactggacctggagatcctcttcttggtggcagcagccacaagacgcccactcccaggtgcaggtggtgcagtcgtggggctggaggtgaaaggacgcccggggctcgagtgaaggtcnccngcaagacctnggctacnccttnagtgacaacaacgtcacgtggtcncgccgacggcccctaggacgaaggtccttaggagtggagtgggtaattggtttgctaggaagtaacgtgggtacgaccgtataaattagcgacgaacgtagggttacgggtttcggggactaagggtcagttcaggtacggacccgggtataccgtcgaatcccgacctaaaccgtaacttacaaagtcggtaactacggaacccttaggtaacctaggaacttacgtttaacggaaccgtaacgttaccgggttcccgttattaacctttagcgttacgacgttacgaaggaacggccggg

SEQ ID NO: 433909 - DNA, 688 bp, Homo sapiens
  misc_feature: GZ8MTXP01B07X5.51.12.B01.1.454.CMB.2.raw
  modified_base (336)..(336): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgcccccgctcctcaccatggactggacctggagatcctcttcttggtggcagcagccacaagacgcccactcccaggtgcagggtggtgcagtcgtggggctggaggtgaaggacggcccggggctcgagtgaggtctctgcaagacctcgtggacctacaccttcgagtcggaccaactacgtccacgtggggcnccggccacggcccctaggacgagggtccttggaggtggagtgggaattggttgcgtaggagtacgtgggtacgaccgtactaaatttgcgacgacggtaggggttacgggtttaccgggggactaggggtactacgtcgaagggttaccgggaaccccgggggaactacccgggttaccaacgttcccggaaccctaaccgtaaacgtttacgaagttaccgggaaaccttcggaacccgtcggttcgtaacggttacctttacggttacgggaacccgtaaccggttacccgggttcccttaacgttaacgttcgtcggttacggacgttacgtaacgggaacgggccggg

SEQ ID NO: 433910 - DNA, 697 bp, Homo sapiens
  misc_feature: GZ8MTXP01DC95P.51.12.B01.1.454.CMB.2.raw
  modified_base (277)..(277): a, c, t, g, unknown or other
  modified_base (287)..(287): a, c, t, g, unknown or other
  modified_base (293)..(293): a, c, t, g, unknown or other
  modified_base (296)..(296): a, c, t, g, unknown or other
  modified_base (317)..(317): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggagatcctcttcttggtggcagcagccaacaagacgccccactcccaggtgcgaggtggtgcagtcgtggggctggaggtgaagacggcccgggctcgagtgagtcnctgcagcctngctacnctnagtgacaacactcacgtggcnccgccgacggccctggaacgagggtccttaggaggtggagtgggtaatttgggttaacgcgtaggaacgtaacggtcggtcggacccgtaaataaagtttgcggaacgtaacgggtaggggttacgggtttccgggggacgttacggggtacaagttaccgaggtaccggggaacccggggtacgtacccgggttaccaaagttccccggaacctaaacgtaaaccgtttacaaacgggtttcgggaaacctttacgggaaccctaggtttccctaggttaaaccgttagtttaaccgggaaaccgtaacccggttaccgggttcccgtttacttaacgttcgtaaggtccggaacgaacgaacgggttaacgggccggg

SEQ ID NO: 433911 - DNA, 624 bp, Homo sapiens
  misc_feature: GZ8MTXP01BVWBC.51.12.B01.1.454.CMB.2.raw
  modified_base (276)..(276): a, c, t, g, unknown or other
  modified_base (278)..(278): a, c, t, g, unknown or other
  modified_base (285)..(285): a, c, t, g, unknown or other
  modified_base (292)..(292): a, c, t, g, unknown or other
  modified_base (295)..(295): a, c, t, g, unknown or other
  modified_base (319)..(319): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccaacaagacgccccactcccaggtgcgaggtgtgcagtcgtggggctggaggtgaaggacggcccgggctcgagtgagtcncngcaagcntgctacnctnagtgacaacgacgtccagtggtcnccgccgacggccccgtaggacgaaggggtcccttaggaggtggatggggtaaattggttaagctaggagtacgtgggtcgaccgtataaaagttcgtaggaccgtaacggtagggttacgggtttaccggggataaggggtcctaagtaccgaaggttaccgggaacccggggtactaaccggtcctagtcccgaaccaaccgtaacttagacgtagtaaccgtgaccctagtctagttacgtagttcgaccgtacgaccgttcgttactaagtcgtaagtcgaccgagtaacgaacgggccggg

SEQ ID NO: 433912 - DNA, 728 bp, Homo sapiens
  misc_feature: GZ8MTXP01EF34M.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaacccccctgagagcccccgctcctcaccatggactggacctggaggatcctcttcttggtggcagcagccacaagacgccccactcccaggtgcgagggtggtgcagtcgtggggctggaggtagaaggaacggcccggggctcgaggtgaaggtctcctgacaacgacctcgtcggcctaacctaccctttcgaggtcggaccaaaccgtaaccgtccgacggtggggtcacccggccgaccggccccctagggaacgtacggggtccttacggaggtggagtggggtaaacgtttgggtttaacggtacgtagggtaacgtaacgttggggtacgaccgtaaagttaaagttagtacgacgaacggtagggttacggggtttaccggggacggtacgggtacaacgtcgaaggttaccggggaccccggggtaacgtaccgtacccgaacgttacccgaacctaaccgtaaccgttaacgaacgttacgaaccgtaccgaaccgtcggtaacgtagttactaacgtttacggaacccgtaacgttaccggttccgttactaagttacgtcggtacgacgagaacggaacggaaccggg

SEQ ID NO: 433913 - DNA, 669 bp, Homo sapiens
  misc_feature: GZ8MTXP01DOSI6.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagccccgctcctcaccatggactggacctggaggatcctcttcttggtggcagcagccacaagacgccccactcccaggtgcaggtggtgcagtcgtggggctgaggtgaagacggcccggggctcgagtgaaggtctccgtgacaagcctcgtggctacctaccttcaggtcgaccaacaaccggcccaggttgggcgccgaccgacggcccctaggaccgaaggggcctttacggaggtgggaagtggggtaaactttggggtttaacgctagggaacgtaacgtgggtaccgaccgataaatttcgaggacgaacggtagggttaacgggtttcgggggactaaggggtctagtacgaacggttacgggacccggggaactacccggtacgacgtcccgacctaaaccgatttaccgagtacggtaacagtacccgtgtaaccgtgaaccttagtttcgaacggtcccgttacggttccttacgttaacgttcgtcgttcggaccaacgggtaagaacgggcccggg

SEQ ID NO: 433914 - DNA, 631 bp, Homo sapiens
  misc_feature: GZ8MTXP01AITYS.51.12.B01.1.454.CMB.2.raw
  modified_base (282)..(282): a, c, t, g, unknown or other
  modified_base (292)..(292): a, c, t, g, unknown or other
  modified_base (301)..(301): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaacccccctgagacgcccccgctcctcaccatggactggacctggaggatcctcttcttggtggcagcagccaacaagacgccccactcccaggtgcgaggtggtgcgagtcgtggggctggaggtgaaggacggcccgggctcgagtgagtcnctgacagctngctacactnagtgacaacacgtcacgtggcgcgccgacggccctaggacgagggtccttggaggtggagtgggtaagtttgggtttgtcgtaggacgtacgtgggtcgaccgtataaagttgcggacgtacggtagggttagggtttcccgggggatacgggtactagttaccgaaggttaccggggaacccgggactaacggtccagtaccccgactaaactacgttacgagtacggtaactcgaaccgtgtaactggttactgttacgaccgtaacgttcccgggttaccttggtaactttacggcgtagacccgggagtaacgggaacggccgggg

SEQ ID NO: 433915 - DNA, 629 bp, Homo sapiens
  misc_feature: GZ8MTXP01ER2OX.51.12.B01.1.454.CMB.2.raw
  modified_base (272)..(272): a, c, t, g, unknown or other
  modified_base (284)..(284): a, c, t, g, unknown or other
  modified_base (290)..(290): a, c, t, g, unknown or other
  modified_base (293)..(293): a, c, t, g, unknown or other
  modified_base (315)..(315): a, c, t, g, unknown or other
  modified_base (396)..(396): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaacccccctgagagccccgctcctcaccatggactggacctggaggatcctcttcttggtggcagcagccacaagacgcccactcccaggtgcaggtggtgcagtctggggctgaggtgaagaggcccggggctcagtgaggtcncctgcagacctngctacnctnagtgcaacacgtcacgtggtcncgccacggcccctggacgagggcttggagtggagtgggaattgggttaagtctaggagtacgtgggtcgacgactaaattntgacacgagggtaggttcggggctagggtcagttcgagtacgggaacccggggacaccggttaccagttacccggaccaaccgtaaacctttaacgaacgttacgggaaaaccttcggaaaccctagggtaacccttaggaaactcgttttaacggaccggtaccttaaccgggttccgtttacttaacgttacgtcggtcggaccggaacgtaacgggaaaggtcccggggg

SEQ ID NO: 433916 - DNA, 625 bp, Homo sapiens
  misc_feature: GZ8MTXP01BD435.51.12.B01.1.454.CMB.2.raw
  modified_base (281)..(281): a, c, t, g, unknown or other
  modified_base (284)..(284): a, c, t, g, unknown or other
  modified_base (401)..(401): a, c, t, g, unknown or other
  modified_base (533)..(533): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgcccccgctcctcaccatggactggacctggaggatcctcttcttggtggcagcagccacaagacgccccactcccaggtgcgagggtggtgcagtcgtggggctggaggtgaagacggcccggggctcagtgaaggtcnccngcaagcctcgcggcctacacctttcgaggtcgcaaacgacgtccacgtgggtcgccgccgacggcccctgggaacgagggtccttgggagtgggagtggggtaattcgggttttaancgagggtaagtacgtgggtcgacccgtataaaatttgcggacgtacggaggggttagttcccgggggagtagggtaccaagtcgaagtacgggacccggggaaccgcgtcacgtcccgactaactaactagngtacgtactcgaacctgtaacgagttacgtcgttacggaaccgtacgaccgttcttactaagttcgcggacgacgaagaacggaacggtcgg

SEQ ID NO: 433917 - DNA, 677 bp, Homo sapiens
  misc_feature: GZ8MTXP01CD36C.51.12.B01.1.454.CMB.2.raw
  modified_base (281)..(281): a, c, t, g, unknown or other
  modified_base (284)..(284): a, c, t, g, unknown or other
  modified_base (301)..(301): a, c, t, g, unknown or other
  modified_base (334)..(334): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtccctctagacgaaccccctgagacgcccccgctcctcaccatggactggacctggaggatcctcttcttggtggcagcagccacaagacgccccactcccgaggtgcgaggtggtgcagtcgtggggctggaggtgaaggacggcccgggctcgagtgagtcnccngcaagcctgtgcctacnccttgagtcgaccaaacaccgtcacgtgggtcnccgccgacgcccctaggaccgaggggtcccttaggacggtggtagtggggtaattgggtttaacgcgtaggaacgtacgtgggtacgcctaataaagtttcgcggactaacgggtagggttacggggtttccggggacgtaagggttcaacgttcgaaggtaccggggaaccccggggtaatcccggttaaccgagtaccccgacgtaaaccttaaccgttaacgaggttacggactacgaccgtaggtctacggttaacttacggttcgaaacccggtcgttaccggttcctttaactaagtttccgtggtacgaccggttataacggggaacggtcccggg

SEQ ID NO: 433918 - DNA, 577 bp, Homo sapiens
  misc_feature: GZ8MTXP01D1E6A.51.12.B01.1.454.CMB.2.raw
  modified_base (272)..(272): a, c, t, g, unknown or other
  modified_base (274)..(274): a, c, t, g, unknown or other
  modified_base (281)..(281): a, c, t, g, unknown or other
  modified_base (292)..(292): a, c, t, g, unknown or other
  modified_base (317)..(317): a, c, t, g, unknown or other
  modified_base (440)..(440): a, c, t, g, unknown or other
  modified_base (513)..(513): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcaggtggtgcagtctggggctggaggtgaagacgcccggggctcagtgagtcncngcagctntgctacacttnagtgacaacacgtccacgtgggtcnccgccgacggccccctgggacgaaggggtccttaggagtggatggggtaattgggtttaagtctaggacgtaacgtgggtcgaccgataaattgtcgacacgagggtacgggtttaccggggngtagggtacagtcgaagtacgggaccggggactacgtccactccgaccaactactacagtacgactacgaccngtctgactattcgaccgacaccggttccttataagttactggtgaccgagaaggcggaaccggg

SEQ ID NO: 433919 - DNA, 687 bp, Homo sapiens
  misc_feature: GZ8MTXP01E2Z0J.51.12.B01.1.454.CMB.2.raw
  modified_base (278)..(278): a, c, t, g, unknown or other
  modified_base (289)..(289): a, c, t, g, unknown or other
  modified_base (295)..(295): a, c, t, g, unknown or other
  modified_base (299)..(299): a, c, t, g, unknown or other
  modified_base (322)..(322): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaacccccctgagacgccccgctcctcaccatggactggacctggaggatcctcttcttggtggcagcagccacaagacgccccactcccaggtgcaggtggtgcagtcgtggggctggaggtgaaggacggcccggggctcagtgaagtcnctgcagcctgngctacncttnagtgacaacacgtccagtggtcnccgccgacggcccctaggacgaagggtccttaggagtggagtgggtaattgggtttaagtcgtagggaaacgtaacgttgggtacgacccggtaaattaaagttagtcggacgtaacgggtaaggggttacggggttttacgggggaccgttagggggtacctaagttaccgaacgggttaccggggaaaccccgggggacctaccggttacccaccgtaccggaaccctaacctaaacgttacgaagttacggaacctacgaaccagggttcctaggttaacttacgtttacgaaccggtaaccgaccgggttccttacttaacgtacgtggtacgaccgaagtaacggaacgggtaacccggg

SEQ ID NO: 433920 - DNA, 706 bp, Homo sapiens
  misc_feature: GZ8MTXP01EZSGZ.51.12.B01.1.454.CMB.2.raw
  modified_base (281)..(281): a, c, t, g, unknown or other
  modified_base (283)..(283): a, c, t, g, unknown or other
  modified_base (292)..(292): a, c, t, g, unknown or other
  modified_base (298)..(298): a, c, t, g, unknown or other
  modified_base (303)..(303): a, c, t, g, unknown or other
  modified_base (326)..(326): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaacccccctgagacgccccgctcctcaccatggactggacctggaggatcctcttcttggtggcagcagccaacaagacgccccactcccaggtgcgagggtggtgcgagtcgtggggctggaggtgaagacggcccggggctgagtgaagtcncngcaagcctngctacnccttnagtgacaacacgtcacgtgggcncgccacggccctaggacgagggtccttaggaggtggagtggggtaaattgggtttaacgtcgtaggaacggtaaccgttggggttacgacccgtaaataaatttagtcggacgtaacggtacggggttacgggttttacccggggggacgttaacgggggtacctaagttaccgtaaggttaccgggggaaccccgggggtacgtacccggttacccgacgttaccccggaaccctaaacccgttaaccgtttaacgaacgttacggtaaccgttacgaacccgtgttcgtacgttaaacttacggtttacggaaccgtaccgttaccgggttccttacttaagttaccgtggtcgacgacgtaaggaacgggaaccggg

SEQ ID NO: 433921 - DNA, 758 bp, Homo sapiens
  misc_feature: GZ8MTXP01EL4ID.51.12.B01.1.454.CMB.2.raw
  modified_base (276)..(276): a, c, t, g, unknown or other
  modified_base (352)..(352): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggagatcctcttcgttggtgcagcagccacaagcgcccactccgaggtgcgaggtggtgcagtcgtgggctggaggtagaagacggcccgggctcgagtgaacgtcncgagcaagtcctcgtacgacctacctaccttgaggtacggaccaaacgtaaccggttccgtacggtcgggggtacncccggccgaaccggtccccgtaggtacggaaacggggttcccctttaagggagggttacgggtaaggttagggggttaaacgtttggggttttaacgacgtacgggtaaacggtaacgttcggggtaacgacccgtaaattaaagttcgcggtaccgtaagggtaacgggttcgggggtttaccgggcgttaaagggtcctaagtaccgggtaacgtacgggggaaccccggtaactaccgggttaccaaggttccccgaaacctaaacgttaacgtttaacgaacggtaccgtaaaactcccgtacgtagggtaactacgggttaactcggtttaccgaaccgtaacggttaccggttcttattaacggtacgtcggtacgacgaacgtaacgggaacgggccgg

SEQ ID NO: 433922 - DNA, 694 bp, Homo sapiens
  misc_feature: GZ8MTXP01AR5TI.51.12.B01.1.454.CMB.2.raw
  modified_base (276)..(276): a, c, t, g, unknown or other
  modified_base (306)..(306): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctggaggtgaagacggcccggggctcagtgaacggtcncctgccaagacctcgtggcctacacccttnagtggaccaacaacgtccagtgggtcgccgccgacggcccctaggacaaggggtccttggaggtggagtgggtaattagggtttaagtcgtaggacgtaacgtgggtcgccgtaaactaaattagtcgacgtacggtagggtagggtttccgggggcgtaaggggttcagttaccgaaggtccggggaacccgggggtacctaccgttccgaaccgttacccggtacccctaaaccgtaaaccgtttacgaacggttacgggaaaccttacgaacccgtggttaaccctaaggttactttaacgtttccgggaaaccgtaccgaccggggttcctttaagttaaccgttacgtcggtaggaccgttaccggaaggttaacggccgggg

SEQ ID NO: 433923 - DNA, 718 bp, Homo sapiens
  misc_feature: GZ8MTXP01A2C9Q.51.12.B01.1.454.CMB.2.raw
  modified_base (280)..(280): a, c, t, g, unknown or other
  modified_base (288)..(288): a, c, t, g, unknown or other
  modified_base (296)..(296): a, c, t, g, unknown or other
  modified_base (299)..(299): a, c, t, g, unknown or other
tcagcgatcgtatacacgaccggtgctcgatttagtagtgtagattccgcgggcacgaccggtgctcgatttgtagtgtagattccgcggggggagcatcacccagcaaccacatctgtcctctagagaaccccctgagacgccccgctcctcaccatggactggacctggaggatcctcttcttggtggcagcagccacaagacgccccactcccgaggtgcgagggtggtgcagtcgtggggctggaggtgaagacggcccggggctcgagtgagtcnctgcagcngtgctacnctnagtgacacacgtcagtggtgcgcgacggccctggacgagggtcctggaggtggagtgggtaattgggttgtcgtagggaacgtacgtgggtacgccgtaattaaacgtttgcggacgtaacggtaggggtttacgggtttccgggggacgttaggggtaccagtaccgtaacgggtaccggggaacccgggggacctacccggttaccacgttaccccgaacctaaaccgtaaccgtttaagaacgggttacgggaaacccttaccgggaaaacccgtttgggtccttaacgggttaaaccctttagggtttaacccgggaaacccgtaaacccgggttcccgggttaccgtttaccgtttaaacgtttccggtcggtacgggaacccgttaaaggtaacggggaacgggtcccggggg

SEQ ID NO: 433924 - DNA, 692 bp, Homo sapiens
  misc_feature: GZ8MTXP01EC7K8.51.12.B01.1.454.CMB.2.raw
  modified_base (292)..(292): a, c, t, g, unknown or other
  modified_base (373)..(373): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaacccccctgagacgcccccgctcctcaccatggactggacctggagatcctcttcttggtggcagcacgccacaagacgccccactcccgaggtcgcgaggtgtgctagtcgtggggctggaggtagaacgaacggcccggggctcgaggtacgaacggtccnccgtagacaacggaccctcgtacggtactaacctacctttcgaggtacgacctaaacgtaccgtcccgacgttcggggtcnccgtacccgacggtcccccgtaggaccgtagggtcccttagggaggtacggagttaggggtaagttagggtttaacggccgttaggaaacgtaacgttggggtacgaccgtaagtaaattagcgacgacgtagggtaggtttaccgggcgtaggtacagtacgtacggtacgggaacccgggactaccggtctaccgacctaccgaacgtaaccgtagtaacgtacggaccttacgacgtactaacgtacgttattacgttacggaaccgtacgaccggttcttacttaacgttcgcgtacgagacgaacggccggcgg

SEQ ID NO: 433925 - DNA, 681 bp, Homo sapiens
  misc_feature: GZ8MTXP01AGJJ3.51.12.B01.1.454.CMB.2.raw
  modified_base (281)..(281): a, c, t, g, unknown or other
  modified_base (603)..(603): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaacccccctgagacgcccccgctcctcaccatggactggacctggaggatcctcttcttggtggcagcagccacaagacgccccactcccaggtgcaggtgtgcagtcgtggggctggaggtgaaggacgcccggggctcgaggtgacggtcncgtgacaacgacctcgtcggcctacctacccgttcgacggtcggaccaaaccgtaaccggtcccacggtcgggtcgcccggacccgaccggtcccccgtagggaacccgtaaggggtccctttagggaggttgggaagtgggtaaagttcgggtttaagcgtaggaacgtacgtgggtcgacgtaactaaagttgacgacgacggtaagggttacgggtttacgggggcgtaggggtaccagtaccgaggtaccgggaacccggggtactaccggtccctacgtcccgaacctaacgtaacttacgagtacggacctcgacncgtaactgttactagttcggaccgacgttccggttccgttataagtttcgaagtcgacggacgaacggaacggccggg

SEQ ID NO: 433926 - DNA, 522 bp, Homo sapiens
  misc_feature: GZ8MTXP02JUIPU.51.12.B01.1.454.CMB.2.raw
  modified_base (321)..(321): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacaacgtccactgggtncgccaggccccctggacaaggggccttgagtggatggggatgggtttgtctgagactgggtgccgcaaattatgcacaggagtttcgggggcaggggtcatcagtggaccggggacacgtccatcgccacaacttacatggaactgaccagtctgacattgacgacacggccgtctaattactgtcgcgacacgaagcggg

SEQ ID NO: 433927 - DNA, 558 bp, Homo sapiens
  misc_feature: GZ8MTXP02FUH6C.51.12.B01.1.454.CMB.2.raw
  modified_base (284)..(284): a, c, t, g, unknown or other
  modified_base (297)..(297): a, c, t, g, unknown or other
  modified_base (537)..(537): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagagcccggggctcagtgaaggtctcctgcaagacctntggctacaccttnagtggcaacaacgtccactgggtgcgccaggcccctggacagggccttgagtggatggggattgggtttgtctggagaacgtgggtgccgactaaattatgcacgagggtagtttcgggggctaggggtcatcgagtcggacccgggggacaccggtccatccgacccaactaacttacataggaacctgaccagtctagactagtttacgacgtacgaccggtccgtactaatttacgngtacgcgaacgaggaggccgg

SEQ ID NO: 433928 - DNA, 641 bp, Homo sapiens
  misc_feature: GZ8MTXP02HM5YK.51.12.B01.1.454.CMB.2.raw
  modified_base (275)..(275): a, c, t, g, unknown or other
  modified_base (285)..(285): a, c, t, g, unknown or other
  modified_base (322)..(322): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactccccaggtgcagggtggtgcagtctggggctgaggtgaagagcccggggctcagtgaggtctccngcaagacctntggctacaccttcagtgcaacaacgtccacgtgggtncgccaggcccctggacaggcctgagtggatggggattgggtttagtctgagtaacgtggtcgccgataaattagtgactacgagggtacggttttcgggggacgtagggggttacagttaccgaggttacgggaacccgggggaactaccgggtttacccaagttcccggacccgaactaaacctttaaccgagttacgggaaaccttacggacctaacggttcctaggaaccttaagtttacggaaaccgtaaccgacccgggtaccgttaccttaagtttaccgtggttcgaccggaacgacggaaacggcccgggg

SEQ ID NO: 433929 - DNA, 515 bp, Homo sapiens
  misc_feature: GZ8MTXP02F19YK.51.12.B01.1.454.CMB.2.raw
  modified_base (384)..(384): a, c, t, g, unknown or other
  modified_base (431)..(431): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccactgggtgcgccaggcccctggacagggccttgagtggatgggattgggttagctgagaactgggtgccganaaattatgcacaggtagtttcggggcagggtcatcagtgaccggganacgtcatcgacacacttacatggactgaccagtctgactattagacgacacggcctactaattactgtcgacgacacgaagcgg

SEQ ID NO: 433930 - DNA, 523 bp, Homo sapiens
  misc_feature: GZ8MTXP02JB8RY.51.12.B01.1.454.CMB.2.raw
  modified_base (386)..(386): a, c, t, g, unknown or other
  modified_base (436)..(436): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagagcccggggctcagtgaaggtctcctgcaagacctctcggctacacctttcagtggcaacaacgtccactgggtgcgccaggcccctggacaagggccttgagtggatggggatggtttgctgagaactggtgccganaaattatgcacgaggagtttcggggcaggggtcagtcatggaccgggganacggtcatccgcacaacttacatggactgaccagtctgactagttgacgacgacggcgtactaattactgtcgcgtacagaagccgg

SEQ ID NO: 433931 - DNA, 526 bp, Homo sapiens
  misc_feature: GZ8MTXP02G0M4S.51.12.B01.1.454.CMB.2.raw
  modified_base (391)..(391): a, c, t, g, unknown or other
  modified_base (499)..(499): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagagcccggggctcagtgaaggtctcctgcaagacctctggctacaccttcagtggcaacaacgtccactgggtgcgccaggcccctggacaagggccttgagtggatgggatgggttgtctgagaactgggtgccgacaaattntgcacgagggtagtttcgggggctaggggtcatcagtcggaccggggacacgtcatcgcacaacttacatggactgaccagtctgactattgacgtacgacggccgtntaagttactgtacgcgacagaagccgg

SEQ ID NO: 433932 - DNA, 533 bp, Homo sapiens
  misc_feature: GZ8MTXP02HSLSX.51.12.B01.1.454.CMB.2.raw
  modified_base (320)..(320): a, c, t, g, unknown or other
  modified_base (392)..(392): a, c, t, g, unknown or other
  modified_base (514)..(514): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagagcccggggctcagtgaggtctcctgcaagcctctggctacaccttcagtggcaacaacgtccacgtgggtnccgccaggcccctggaccaagggccttggagtggatggggattgggtttatcgtgagaacgtgggtgccganaaattatgcacgaggagtttcggggcgagggtcagtcagtggaccgggacacgtcatcgaccacaactacatggaactgaccagtctagactattcgacgtacgacggccgtctaattacgngtcgacgacagaacgcggg

SEQ ID NO: 433933 - DNA, 530 bp, Homo sapiens
  misc_feature: GZ8MTXP02IQ62M.51.12.B01.1.454.CMB.2.raw
  modified_base (320)..(320): a, c, t, g, unknown or other
  modified_base (390)..(390): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtggtgcagtctggggctggaggtgaagagcccggggctcagtgaaggtctcctgcaagacctctggctacaccttcagtggcaacaacgtccactgggtncgccaggcccctggacaaggccttgagtggatgggattggttagctagagaactgggtgccgacaaattngacacgaggtagtttcgggggcaggggtcagtcatggaccggggacacggtcagtcgaccacactacatggaactgaccagtctgactattcgacgtacacggtccgtataacgttactggtcgacgacaggaacgcggg

SEQ ID NO: 433934 - DNA, 524 bp, Homo sapiens
  misc_feature: GZ8MTXP02GQ0LK.51.12.B01.1.454.CMB.2.raw
  modified_base (321)..(321): a, c, t, g, unknown or other
  modified_base (380)..(380): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctggaggtgaagagcccggggctcagtgaaggtctctgcaagacctctggctacaccttcagtggcaacaacgtccactgggtncgccaggcccctggacaaggccttgagtggatgggatggttagctgagactggtgccgnaaattatgcacaggtagtttcgggggctaggggtcagtcagtaggaccggggacacggtccagtccgaccaacaacttacatacggactgaccagtctgactattgacgtacacggctactaatactgtcgcgacagaacgcgg

SEQ ID NO: 433935 - DNA, 571 bp, Homo sapiens
  misc_feature: GZ8MTXP02F7GGP.51.12.B01.1.454.CMB.2.raw
  modified_base (286)..(286): a, c, t, g, unknown or other
  modified_base (400)..(400): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagacggcccggggctgagtgaaggtctcctgcaagcctngctacacttcagtgcaacacgtccagtggcgccgccgacggcccctggacagggccttgagtggagtgggattgggtttagctggagtaacgtgggtcgccgtataaaatttangacacgagggtaggtttcgggggactaggggtcagtacgagtacgggacccggggactacgtccagtccgaccaacaacttacagtacggaacctcgacctagtctagaacttagttacgaaccgacgaccggtccgtactaagtacgtgtcgacgacgaggaaggccggg

SEQ ID NO: 433936 - DNA, 553 bp, Homo sapiens
  misc_feature: GZ8MTXP02H9HK5.51.12.B01.1.454.CMB.2.raw
  modified_base (287)..(287): a, c, t, g, unknown or other
  modified_base (295)..(295): a, c, t, g, unknown or other
  modified_base (325)..(325): a, c, t, g, unknown or other
  modified_base (403)..(403): a, c, t, g, unknown or other
  modified_base (531)..(531): a, c, t, g, unknown or other
tcagcgatcgtatacacgaccggtgctcgatttagtagtgtagattccgcgggcacgaccggtgctcgatttgtagtgtagattccgcgggggagcatcaccccagcaaccacatctgtcctctagagaaccccctgagagccccgctcctcaccatggactggacctggaggatcctcttcttggtggcagcagccacaagagccccactcccaggtgcaggtggtgcagtcgtggggctgaggtgaagaagcccggggctcgagtgaggtctcctgcaagacctntggctacnccttcagtggcaacaacgtccacgtgggtncgcaggcccttggacagggctgagtgagtgggattgggtttgtcgtagagtaacgttgggtcgccgtacaaagtttangacacgagggagtttcgggggctaggggtcagtcagtcggaccggggacacgtccatccgaccacgaacttcagtcggaactgaccagtcagtactattagacgtacgacggtcctactaagttaccnggtacgacgacaggacgccggg

SEQ ID NO: 433937 - DNA, 536 bp, Homo sapiens
  misc_feature: GZ8MTXP02HZRYS.51.12.B01.1.454.CMB.2.raw
  modified_base (287)..(287): a, c, t, g, unknown or other
  modified_base (317)..(317): a, c, t, g, unknown or other
  modified_base (391)..(391): a, c, t, g, unknown or other
  modified_base (444)..(444): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagagcccgggctcagtgagtctctgcaagactctggctacnccttcagtggcaacaacgtccacgtgggtncgccaggcccctggacaagggccttgagtggatgggattgggtttgtctggagaacgtggtcgccgataaattntgcacgaggtggtttcgggggctaggggtcattcgaagtcgggaccggggacncggtaccatccgaccactaactacataggaactgaccagtctagactattgacacgacggtcctataagtacgtgtcgcgacgagaaggcgg

SEQ ID NO: 433938 - DNA, 576 bp, Homo sapiens
  misc_feature: GZ8MTXP02H9L2I.51.12.B01.1.454.CMB.2.raw
  modified_base (321)..(321): a, c, t, g, unknown or other
  modified_base (386)..(386): a, c, t, g, unknown or other
  modified_base (393)..(393): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccaacaagagcccactcccaggtgcaggtggtgcagtcgtggggctggaggtgaagaagcccggggctcagtgaaggtctcctgcaagacctctggctacacttcagtgcaacaacgtcactggngcgccaggcccctggacagggcctgagtggatgggattggtttagctgagtactgggtcgccganaaattangacacgaagggtaggttttcgggggctaggggtcaagtcagtacgggaccggggacacggttccaactccgaccaacgtaaacttacagttacggaaactggaaccacggttctagtactagttacgacgtaccgacggtcccgttactaagttacgtacgacgacgaacgaacggacggcgg

SEQ ID NO: 433939 - DNA, 557 bp, Homo sapiens
  misc_feature: GZ8MTXP02GNC3J.51.12.B01.1.454.CMB.2.raw
  modified_base (272)..(272): a, c, t, g, unknown or other
  modified_base (281)..(281): a, c, t, g, unknown or other
  modified_base (294)..(294): a, c, t, g, unknown or other
  modified_base (395)..(395): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagagcccggggctcagtgaggtctcngcaagcctntggctacaccttnagtggcaacacgtccacgtgggtcgcgccacggcccctggaacagggccttgagtggatgggattgggtttagctggagaacgtgggtcgccgataaattntgcaacgagggtaggtttcggggcgtaggggtcagtcgagtcggaaccggggacacgtccagtccgaccaactaacttacagtacggaactcgacagtcctagactagtttacgacgtacgacggtccgtactaagttacgtgtcgacgacgaggaacgcgg

SEQ ID NO: 433940 - DNA, 540 bp, Homo sapiens
  misc_feature: GZ8MTXP02HY84J.51.12.B01.1.454.CMB.2.raw
  modified_base (321)..(321): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagcctctggctacaccttcagtggcaacaacgtccacgtggggtnccgccaggcccctggaccaagggccttgagtggatgggatgggtttgctgagactggtcgcgactaaatatgacacgaggagtttcggggctagggtcagtcagtggaccggggacacgtccagtcgaccacgtaacttacagtggaactgaccagtctagactagtttcgacgtacgacggtcctctaacgttacgtgtcgacgacgaggaacgcggg

SEQ ID NO: 433941 - DNA, 607 bp, Homo sapiens
  misc_feature: GZ8MTXP02HG382.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctggaggtgaagacgcccggggctcagtgaaggtctctgcaagacctctggctaccaccttcagtggacaacaacgtccacgtgggtcgccgccacggcccctggacaagggcctgagtggatggattgggtttgtcgtagagacgtgggtcgccgtataaattagtgacacgaggtaggtttcgggggacgtaggggtcagtcgagtcgggaaccggggactaccgtccaacgttccggacccaaacgtaaccttacgacgttaggaacctacggaccctaggtcctagaactacgtttacgaaccgtaccggaaccggtcccgttacttaacgttacgtcgtacggaccgaacgaggaacggccggg

SEQ ID NO: 433942 - DNA, 566 bp, Homo sapiens
  misc_feature: GZ8MTXP02H40I4.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagagcccggggctcagtgaggtctcctgcaagacctctggctacaccttcagtgcaacaacgtccacgtgggtgcgccaggcccctggacgaaggcctgagtggatgggattggtttgtctgagtacgtggtcgacgtataaattgtgacacgtagggtgggtttcgggggacgtagggtcagtcgaggtcgggaacccgggacacgtacacgtccgaccaactaacgtacagtacgaactgaccagtctacgtactcttacggaacgtaccgacggtccttagttaagttcgtaggtcgacgtaacgaggaacggcggg

SEQ ID NO: 433943 - DNA, 638 bp, Homo sapiens
  misc_feature: GZ8MTXP02HPME5.51.12.B01.1.454.CMB.2.raw
  modified_base (277)..(277): a, c, t, g, unknown or other
  modified_base (324)..(324): a, c, t, g, unknown or other
  modified_base (395)..(395): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttctggtggcagcagccacaagacgcccactcccaggtgcaggtggtgcagtcgtggggctggaggtgaagagcccggggctcagtgaaggtctccngcaagacctcgtggctacaccttcaggtgcaacaacgtccagtggtncgccaggcccctggacaaggcccttagagtggagtgggattgggtttatcgtgaagacgttggtcgcctanaaattgcgacacgtagggtagttttcgggggaccgtaggggtacctaagtccgaagtcggggaacccgggggactaaccggttccaacgtccggacccaaaccgtaaactttaaccgaagttacgggaaaacctcgggaaaccctaaggttcctagtacctaaagtttcggaacgtaaccgaccggggtaccccttattaaccgtttagccgggtacgaccggtaacgaacggtacggccggg

SEQ ID NO: 433944 - DNA, 704 bp, Homo sapiens
  misc_feature: GZ8MTXP02HEVKP.51.12.B01.1.454.CMB.2.raw
  modified_base (329)..(329): a, c, t, g, unknown or other
  modified_base (413)..(413): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcagggtggtgcagtctggggctgaggtgaagacggcccggggctcgagtgaaggtctcctgcaagacctctggctacaccttcaggtggacaacaacgtccacgtgggtcncgccaggcccctggaacagggccttggagtggatggggtattgggtttagcgtagagtaacgtgggtacgcccgataaaagttntgacaacggtaggggtacgggttttcgggggacgtagggggttacaagttcgaacggttacgggaaccccgggggtaacacccggttaccgaacgttacccgggaaccctaaaccgtaaaccgtttaaccgaagttacggggtaaaaccttaccgggaaaccctacgggtttacctacggtaaacccttaggttttacggaaacccggtaaccgtaaaccggggtcccgtttaactaacgtttaacccgtaggttccggtaccggtaacgaacgggtaaacggcccggggg

SEQ ID NO: 433945 - DNA, 638 bp, Homo sapiens
  misc_feature: GZ8MTXP02JR647.51.12.B01.1.454.CMB.2.raw
  modified_base (239)..(239): a, c, t, g, unknown or other
  modified_base (242)..(242): a, c, t, g, unknown or other
  modified_base (286)..(286): a, c, t, g, unknown or other
  modified_base (321)..(321): a, c, t, g, unknown or other
  modified_base (325)..(325): a, c, t, g, unknown or other
  modified_base (327)..(327): a, c, t, g, unknown or other
  modified_base (330)..(330): a, c, t, g, unknown or other
tcagcgatcgtatacacgaccggtgctcgatttagtagtgtagattcggcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgntangtcttagttcggaccagcagaacgccggcacggccctgtgttgngatgtaataagcagtgagacgccctgaggctccgngagntntcncgtcgactcgagcgacggactcgtcacgtacgtcgactagtcgaggtacgacgtacgagacgaggacggacgacgttactacgtaacttagtttagttaccgtaactaaactaacaaacgacttaaccgtaacgttagtttacggttaactttagttacgtttaccgttaaccggtaacgtaccggtaaccggtaaaccggtaccggtacccgtacccggttcgggtaccggaaccgacccggaaccccgaacccggaccccctaaacccgtttcgtaccgtacccgttaccggtttacccgtccccg

SEQ ID NO: 433946 - DNA, 625 bp, Homo sapiens
  misc_feature: GZ8MTXP02H5SRG.51.12.B01.1.454.CMB.2.raw
  modified_base (296)..(296): a, c, t, g, unknown or other
  modified_base (402)..(402): a, c, t, g, unknown or other
tcagcgatcgtatacacgaccggtgctcgatttagtagtgtagattccgcgggcacgaccggtgctcgatttgtagtgtagattccgcgggggagcatcaccccagcaaccacatctgtcctctagagaaccccctgagagccccgctcctcaccatggactggacctggaggatcctcttcttggtggcagcagccacaagacgcccactcccaggtgcaggtggtgcagtcgtggggctgaggtgaagagcccggggctcagtgaggtctctgcagacctctggctacaccttnagtggcaacaacgtccacgtgggtgccgccaggcccctggacgagggccttaggagtggagtgggattgggtttagcgtagagtacgtggtcgccgactaaattgngtacgaacgagggtacggtttcgggggacgtaggggtcagttcgaagtcgggaaccgggggtacaccggttccacgtccgaccctaactaaaccttacgagttacgggaaacctacgaacccgtaggttactaggtaaccttagtttacggaaccgacccgaccggttaccgtacgttaagttaacgtcggttacgacggaaaccgaaggaacggacccgggg

SEQ ID NO: 433947 - DNA, 541 bp, Homo sapiens
  misc_feature: GZ8MTXP02I4FGD.51.12.B01.1.454.CMB.2.raw
  modified_base (380)..(380): a, c, t, g, unknown or other
  modified_base (386)..(386): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccactgggtgcgccaggcccctggacagggccttgagtggatgggatggttgtctgagactggtgccganaaattntgcacgaggtagtttcggggcaggggtcagtcagtggaccggggacacggtccacgtcgacccacaacttacagtaggaacctgaccctagtctgacctagtttacgacgtacgaccggtccgtactaacgttactgtacgcgacagaacgccgg

SEQ ID NO: 433948 - DNA, 554 bp, Homo sapiens
  misc_feature: GZ8MTXP02J06VN.51.12.B01.1.454.CMB.2.raw
  modified_base (217)..(217): a, c, t, g, unknown or other
  modified_base (448)..(448): a, c, t, g, unknown or other
tcagcgatcgtatacacgaccggtgctcgatttagtagtgtagattccgcgggcacgaccggtgctcgatttgtagtgtagattccgcgggggagcatcaccccagcaaccacatctgtcctctagagaaccccctgagagccccgctcctcaccatggactggacctggaggatcctcttctggtgcagcagccacaagagcccactcccagggtncaggtggtgcagtctggggctgaggtgaagagccccggggctcagtgaaggtctcctgccaagacctctggctacacctttcagtggcaaacaacgtccactgggtgccgccacggcccctggaccaggggcctgagtgatgggattgggtttgctgagactggtcgcgacaaattatggcacgagggagttttcgggggactagggtcaagttcgagtggacccggggancgtccagtccgccacgaacttacatcggaactcggaacctaggtctgactagtttcggacgtacgacggtccgtcttaagttcttgtacgcgacagaacggccggg

SEQ ID NO: 433949 - DNA, 592 bp, Homo sapiens
  misc_feature: GZ8MTXP02IPCZS.51.12.B01.1.454.CMB.2.raw
  modified_base (276)..(276): a, c, t, g, unknown or other
  modified_base (285)..(285): a, c, t, g, unknown or other
  modified_base (292)..(292): a, c, t, g, unknown or other
  modified_base (295)..(295): a, c, t, g, unknown or other
  modified_base (316)..(316): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaacccctgagagccccgctcctcaccatggactggacctggaggatcctcttcttggtggcagcagccacaagacgcccactcccaggtgcaggtggtgcagtcgtggggctggaggtgaagacggcccggggctcgagtgagtctccngcaagcctnggctacnctnagtgacaacacgtcacgtggncgcacggccctggacgaggcctagagtgagtgggattgggttgtctaggaagtacgttgggtcgaccgtaactaaagttagcgacgacggtagggtacgggtttcgggggacgtaggggtacagtcgagtcggaacccggggacacggtccacgtccggaccaactaacttacgaagtcggaactcgaaccctagttcagtactacgttacggaaccgtacgaccggtccgttactaacgttcgacggtacgacgaacgaacggtacggaccgggg

SEQ ID NO: 433950 - DNA, 553 bp, Homo sapiens
  misc_feature: GZ8MTXP02GV4G2.51.12.B01.1.454.CMB.2.raw
  modified_base (324)..(324): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctcgtggctacaccttcaggtggacaacaaccgtccacgtgggngcgccacggcccctggacaagggccttggagtggatggggattgggtttagtctaggagaactgggtcgccgactaaattatgcacgagggtagtttcggggcgagggtcatcgagtggaccgggacacgtcagtcgacacaactacagtagaactgacagtctagactattacgacgacgaccggccgttactaacgttacgtcggtacgacgacgaggaacggcggg

SEQ ID NO: 433951 - DNA, 590 bp, Homo sapiens
  misc_feature: GZ8MTXP02HKOAX.51.12.B01.1.454.CMB.2.raw
  modified_base (280)..(280): a, c, t, g, unknown or other
  modified_base (331)..(331): a, c, t, g, unknown or other
  modified_base (412)..(412): a, c, t, g, unknown or other
  modified_base (476)..(476): a, c, t, g, unknown or other
  modified_base (517)..(517): a, c, t, g, unknown or other
  modified_base (569)..(569): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgcccactcccaggtgcaggtggtgcagtctggggctggaggtgaagacggcccggggctcgagtgaaggtctccngcaagacctctcggctacaccttcagtggacaacaacgtccacgtggggtncgccaggcccctggacaagggcctgagtggatgggattgggttagtctaggagtaacgtgggtcgaccgtacaaaagtttncggacacgtaggggtaaggtttccgggggataggggttccaagtcaaggtcgggaccggggtanaccggttccagtccgaccacgtaacttacagtaggtaaccnggaccagtcgagtaccttagttcgaccaacgcggtacccttataattacggngtacgacgacgaggacggcgg

SEQ ID NO: 433952 - DNA, 611 bp, Homo sapiens
  misc_feature: GZ8MTXP02JZMYF.51.12.B01.1.454.CMB.2.raw
  modified_base (330)..(330): a, c, t, g, unknown or other
  modified_base (420)..(420): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctggaggtgaaggaacgcccggggcctcagtgaaggtctcctgcaagacctctggcctacaccttcagtgacaaacacgtccacgtggggtnccgccgacggcccctgggacgaaggggccttaggagtggagtgggattgggtttagtcgtagagtaacgtgggtcgaccgactaaattangacgaacgagggtagggtttcggggcgtaggggttcagtcgagtacgggaccggggactacgtaccagtccggaccaactaaccttacaacgtacggaacctacgaccagtcctagactacgtttacggaccgaccgtaccggtccgttacttaagttaccgtgtacggacgacgaacggaacggccgggg

SEQ ID NO: 433953 - DNA, 538 bp, Homo sapiens
  misc_feature: GZ8MTXP02HVU0X.51.12.B01.1.454.CMB.2.raw
  modified_base (259)..(259): a, c, t, g, unknown or other
  modified_base (269)..(269): a, c, t, g, unknown or other
  modified_base (278)..(278): a, c, t, g, unknown or other
  modified_base (311)..(311): a, c, t, g, unknown or other
  modified_base (380)..(380): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctnagtgagctcngcaagcctngctacacttcagtggacaacaagtccatgggtncgccaggcccctggacaagggcctgagtggattggggatgggtttagctagagaacgtggtgacccganaaattagtgacacgaggtaggtttcgggggcaaggggtcagtcagtggaccgggggacacgtccaatcgaccacgaactacagtcggaactgacacgtctagacattcgacggtacacggtcctacgtaacttactgtacgacgacaaggaacgcggg

SEQ ID NO: 433954 - DNA, 538 bp, Homo sapiens
  misc_feature: GZ8MTXP02GOGH4.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctggaggtgaagaagcccggggctcagtgaaggtctcctgcaagacctctggctacaccttcagtggcaacaacgtccactgggtgcgccaggcccctggacagggcctgagtggatgggattgggtttagtctgagaactgggtgccgactaaattatgcacgagggtagtttcgggggcaggggtcagtcagtggaccgggggacacgtccatcgaccacaacttacatggaactgaccgagtctagactactttagacgacgacggccgtctaacgttactgtcgcgacagaacgcgg

SEQ ID NO: 433955 - DNA, 748 bp, Homo sapiens
  misc_feature: GZ8MTXP02HJ3N9.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcagggtggtgcagtcgtggggctggaggtgaagacggcccggggctcgaggtgaaggtctcctgcaagcctcgtggcctaaccacctttcaggtcggaccaaaccgaaccgtccacgtggggtcgccggccacggcccctagggacgaaggggtccttggaggtggagtggggtattgggtttagtcgtaggaacgtacgtgggtcgaccgtaactaaaagtttgtacggacaacggtagggttaacggggttttccgggggacgttacggggtactaacggttaccgaagggttaccgggggaaacccgggggtaacctaaccccggggtttacccaaccggttacccggaacccctaaaaccgttaaaacctttaaccgaacggttacgggaaacccgttacggaaacccgttaacgttaccgtacggtaacctttactttacgggaacccgtacccggtaccggggttcccgtttacttaacgtttacgtcgggttacgaccgaaccgaaggaacggggcccgggg

SEQ ID NO: 433956 - DNA, 620 bp, Homo sapiens
  misc_feature: GZ8MTXP02F9O1X.51.12.B01.1.454.CMB.2.raw
  modified_base (309)..(309): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgccccactcccaggtgcagggtggtgcagtcgtggggctggaggtgaagaacggcccggggcctcgagtgaaggtctcctgcaagcctcgtggacctacaccttnagtcggacaacaacgtccacgtgggtacgcgccgacggcccctaggacaagggcctgagtggatgggattgggttagtctaggagacgtgggtcaccgataaaattgtacgactaacggagggttacgggtttacgggggactaacggggtcaagttacgagtacgggaaccgggggactacggtccacgtaccgacccaaacgtaacttaacgagtacgggaacctggaaccctaggtctacgacttacgttacgaccgtacgacggtccttataacgttacgtcgacgacgaacgaggaacggaccggg

SEQ ID NO: 433957 - DNA, 617 bp, Homo sapiens
  misc_feature: GZ8MTXP02IUL17.51.12.B01.1.454.CMB.2.raw
  modified_base (240)..(240): a, c, t, g, unknown or other
tcagcgatcgtatacacgaccggtgctcgatttagtagtgtagattcggcgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggccaggatcacctgctctggagatgcattgaccaaacgntatgcttattggaccagcagaacgccggcacggcccctgtgtggtgatgtaataaagacacgtgagacggtccctgagggactccgtgacgcgtattctcgtcggactccgaggtcgaggggacacggtcaactagttcggccaagtcagtgagaccgacgacgaggagggacggaacgggacgtagtactattagttagtactaaactaacaaacaacgaactaaccgtaagttacgttaacgttacgttacgttacgttacgtaacgtacgtaccgtaacgtaacgtaccgtaccgtaccggtaccggtaccgaccgaacccgaacccgaaccccgaaaccccgtaccgtaccgtacctaccgtacccgttcccg

SEQ ID NO: 433958 - DNA, 591 bp, Homo sapiens
  misc_feature: GZ8MTXP02HCJUI.51.12.B01.1.454.CMB.2.raw
  modified_base (296)..(296): a, c, t, g, unknown or other
  modified_base (323)..(323): a, c, t, g, unknown or other
  modified_base (395)..(395): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcagggtggtgcagtcgtggggctggaggtgaagacgcccggggctcgagtgaaggtctcctgcaagacctctggctacncttcagtgacaacacgtccacgtggcncgccacggcccctggacaggcctggagtggatgggattgggttgtctaggagacgtgggtcaccgataaatntgacacgaggtaggtttcggggactaggggtcagtacgagtacgggacccggggaacaccgttaccaagttccggacctaaacgtaacttacgagttacggaactacgacctagttaccgagtactagttacgaaccgtaccgtaccggtcccttattaacgttacgtggtacgaccgacgacggaacggccgggg

SEQ ID NO: 433959 - DNA, 578 bp, Homo sapiens
  misc_feature: GZ8MTXP02JX8EH.51.12.B01.1.454.CMB.2.raw
  modified_base (297)..(297): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcgagtgaaggtctcctgcaagacctgtggctacaccttnagtggcaacacgtccacgtgggtcgccgccaggcccctggacgaagggtcctggagtggagtggggattgggtttagtcgtaggagtaacgtggggtcgaccgtactaaaagttagtggacgaacgtagggtacggtttcgggggacgtaggggtcaagtcgagtacgggaccggggacacggtccagtccgacacaacttacagtcggaactgaccagtctagactagtttcgaccgacgccggtccgtattaacgttactgtcgacgacaggacgccgg

SEQ ID NO: 433960 - DNA, 553 bp, Homo sapiens
  misc_feature: GZ8MTXP02GA6OP.51.12.B01.1.454.CMB.2.raw
  modified_base (277)..(277): a, c, t, g, unknown or other
  modified_base (301)..(301): a, c, t, g, unknown or other
  modified_base (320)..(320): a, c, t, g, unknown or other
  modified_base (362)..(362): a, c, t, g, unknown or other
  modified_base (378)..(378): a, c, t, g, unknown or other
  modified_base (384)..(384): a, c, t, g, unknown or other
  modified_base (442)..(442): a, c, t, g, unknown or other
  modified_base (536)..(536): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtgcagcagccacaagagcccactcccaggtgcagggtggtgcagtcgtggggctggaggtgaagaacgcccggggctcagtgaaggtctccngcaagacctctggctaacaccttnagtgcaacacgtcatggtncgcaggcccctggacagggctgagtggatgggatgggtttanctggaagacgtgggtncccganaaaattatgacacgaggtaggtttcggggctaggggtcatcgagtcggacccgggganaccggtacaattccggaccaactaaacgttacagtacggaacagaccgagtctaggactagtttagaccgacgacggccttactaagttactgngacgacgagaagccggg

SEQ ID NO: 433961 - DNA, 574 bp, Homo sapiens
  misc_feature: GZ8MTXP02JYRYJ.51.12.B01.1.454.CMB.2.raw
  modified_base (296)..(296): a, c, t, g, unknown or other
  modified_base (398)..(398): a, c, t, g, unknown or other
  modified_base (540)..(540): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctgaggtgaagagcccggggctcagtgaggtctctgcaagacctctggctacaccttnagtggacaacaacgtccacgtgggtcgcgccacggcccctggacaagggtcctgagtggagtggggattgggtttgtcgtaggaagtacgtggtcgccgtanaaattagtgcaacgagggtaggtttcggggactaggggtcagtcgaagtcggaaccggggaccacgtccgacgtccgaccactaacgttacagtcggactagaccgagtctagtactagttacgacgtaccgacgtaccgtntaacgttcgtcgtacgacgacgaaggaacggcgg

SEQ ID NO: 433962 - DNA, 595 bp, Homo sapiens
  misc_feature: GZ8MTXP02G2J80.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctggaggtgaagaggcccggggctcgagtgaaggtctcctgcaagacctctggctacaccttcagtcggacaacaacgtccacgtgggtcgcgccacggcccctggaccgagggccttgaggtggagtggggattgggtttagtcgtggagtaacgtgggtacgccgactaaaagttgtcggacacgtagggtacggtttcgggggactagggtcagtcgagtcgggacccggggacacgtccgataccgaccaactaacttacagtacggactacgaccgtagtactagactacgttacggaccgtacgaccggtccttactaacgttacgtggtacgacgaacgacgaacggacgg

SEQ ID NO: 433963 - DNA, 557 bp, Homo sapiens
  misc_feature: GZ8MTXP02I6OZ2.51.12.B01.1.454.CMB.2.raw
  modified_base (290)..(290): a, c, t, g, unknown or other
  modified_base (295)..(295): a, c, t, g, unknown or other
  modified_base (316)..(316): a, c, t, g, unknown or other
  modified_base (365)..(365): a, c, t, g, unknown or other
  modified_base (370)..(370): a, c, t, g, unknown or other
  modified_base (377)..(377): a, c, t, g, unknown or other
  modified_base (421)..(421): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctggaggtgaagagcccggggctcagtgaggtctctgcaagcctctggctacnccttnagtgcaacacgtccatgggtncgccaggccctggacaggctgagtgatggattggttgctgagactggtnccganaaattgngcacgaggtagttcggggctagggtcagtcagtggaccgggganacggtcagtcgaccaacaacttacagttacggaactcggaacctaggttcctaggaaccttagtttacggaaccgtaccgaccggtcccgttacttaacgtttacgtcggttacgccgaaccgaggaacgccgggg

SEQ ID NO: 433964 - DNA, 637 bp, Homo sapiens
  misc_feature: GZ8MTXP02GKNL7.51.12.B01.1.454.CMB.2.raw
  modified_base (293)..(293): a, c, t, g, unknown or other
  modified_base (343)..(343): a, c, t, g, unknown or other
  modified_base (396)..(396): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcaggtggtgcagtcgtggggctggaggtgaagacggcccggggctcgagtgaggtctcgtgacaacgacctcgnggcctaacctaccttcgaggtcggaccaaacgaaccgtccacgtgggtcnccggccacggcccctggacgagggtccttggagtggagtgggattgggtttancgtagaacgtacgttgggtacgaccgtataaagttagtcgacgtaacggtaagggtacgggtttacgggggcgtaggggtctaagtacgtacggtaccggggaacccggggactaccggtaccacgtccgacctaacgtaaacttacgagtacggaactacgaactagtactagactacgttagaccgtacgtacggtacttacgtaacgttacgttggacgcgtaacgacggacggacgg

SEQ ID NO: 433965 - DNA, 713 bp, Homo sapiens
  misc_feature: GZ8MTXP02FHJ6P.51.12.B01.1.454.CMB.2.raw
  modified_base (302)..(302): a, c, t, g, unknown or other
  modified_base (307)..(307): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcagggtggtgcagtcgtggggctggaggtagaaggacggcccggggctcgaggtgaaggtctcctgacaagcctcgtggctacnccttnagtcgacaacacgtccacgtgggcgccgccgacggcccctagggaacgaaggggtccttaggaggtgggaagtggggtattgggtttacgcgtaggaacgtaacgtgggtcgacccgtaataaaagtttcgcgacgtaacggtaggggtacgggtttcgggggacgtacggggtacagttacgacggttacggggaaccccggggactacccggttaccaacggttcccggaaccctaaacccttaaaccgtttaaccgaagttaacgggaaacccttacggaacccgtaggttacgtacggaaacctttaaggtttaccggaaacccggtaaccgtaccggggtaccctttacttaaacgttaccgttggtaccgaccggtaacgaacgggacgggaacccgggg

SEQ ID NO: 433966 - DNA, 737 bp, Homo sapiens
  misc_feature: GZ8MTXP02FU9ZT.51.12.B01.1.454.CMB.2.raw
  modified_base (274)..(274): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctggaggtgaagacgcccggggctcgagtgaggtcncctgcaagacctctggcctacaccttcagtggacaacaacgtccacgtgggtcgccgccgacggccccctagggaaccgaaggggtccctttaggagttgggaagttggggtattggggtttttagcgttaggaagtaaccgtggggtacgacccggtataaaagtttagtcggacgtaacggtaggggtaacgggttttccgggggacgtaagggggttacctaagttaccgagttaccggggaaccccgggggtaacctacccgggtaccctaacgttcccggaaccccgtaaacccgtaaaacctttaaccgaacggtttaacgggaaacccttacggaaaccccgtaaggttaccccgtaggtaaaccttagttttaccggaaccgtaccgtaacccgggtccgttacgttaacgtttaccgtaggttacggaccgtaaccgaaggaacggacccgggg

SEQ ID NO: 433967 - DNA, 665 bp, Homo sapiens
  misc_feature: GZ8MTXP02HL6F8.51.12.B01.1.454.CMB.2.raw
  modified_base (280)..(280): a, c, t, g, unknown or other
  modified_base (303)..(303): a, c, t, g, unknown or other
  modified_base (334)..(334): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccgaggtgcagggtggtgcagtcgtggggctggaggtgaaggacgcccggggctcgagtgaggtctcngacaagcctctggctacaccttnaggtcgacaaacgaacgtccaacgtgggtcncgccacggcccctaggaacgagggccttagaggtggagtggggattggggtttagtcgtaggaacgtacgttgggtacgacccgtaataaaagtttcgacgaaccgaacggtaagggggttacgggtttcgggggactaacggggttacaagttaccgaaggttaccggggaacccgggggtaactaccgggttccaaacgttccgaacctaactaaacgttacgaagttacggaaccttgaaaccctaggttaccacggtaacttacggttacgaaccgtaccggacgttccgttacttaagtacgagtacgacgacgaacggacggcgg

SEQ ID NO: 433968 - DNA, 550 bp, Homo sapiens
  misc_feature: GZ8MTXP02ITF5Z.51.12.B01.1.454.CMB.2.raw
  modified_base (284)..(284): a, c, t, g, unknown or other
  modified_base (291)..(291): a, c, t, g, unknown or other
  modified_base (296)..(296): a, c, t, g, unknown or other
  modified_base (317)..(317): a, c, t, g, unknown or other
  modified_base (374)..(374): a, c, t, g, unknown or other
  modified_base (378)..(378): a, c, t, g, unknown or other
  modified_base (384)..(384): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagagcccggggctcagtgaaggtctcctgcaagcctnggctacnccttnagtgcaacaacgtcagtggtncgccacggcccctggacagggccttgagtggatgggattgggttgctgagactgggncganaaatangcagaggtaggtttcggggcagggtcagtcgagtcgggaccggggacaccggtccagtccgacccaacgtaacttacagtacggaactacgacctagtcctagactagtttacgacgtacgacggtccgtacttaacttacgtggtcgacgacgaggacggacggg

SEQ ID NO: 433969 - DNA, 555 bp, Homo sapiens
  misc_feature: GZ8MTXP02FH1EB.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggacaacaaccgtccactgggtgccgccacggcccctggaccaaggggccttgagtggatgggattgggtttgctgagactggtgccgataaattatgcacgaggtagtttcgggggcaggggtcagtcgagtcggaccgggggacacggtccatccggaccaaccgaacttaacgagtggaactgacccagtcctgactagtttcgacgtacgaccggccgttactaattactgtcgcgaacgaggaacggcggg

SEQ ID NO: 433970 - DNA, 547 bp, Homo sapiens
  misc_feature: GZ8MTXP02F0TI4.51.12.B01.1.454.CMB.2.raw
  modified_base (327)..(327): a, c, t, g, unknown or other
  modified_base (375)..(375): a, c, t, g, unknown or other
  modified_base (397)..(397): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctggaggtgaagacggcccggggctcgagtgaaggtctcctgcaagacctctggctacaccttcagtggacaacaacgtccagtgggtncgccaggcccctggacaagggccttgagtggatgggattgggtttgcngagactgggtgccgataaattntgcacgagggtagtttcgggggactaggggtcagtcagtcggaccggggacacgtccatcgaccaacacttacatggactgaccagtctagactagttacgacgacgacggccgttactaacgttacgtgtcgacgacaaggaacgcggg

SEQ ID NO: 433971 - DNA, 515 bp, Homo sapiens
  misc_feature: GZ8MTXP02JFASP.51.12.B01.1.454.CMB.2.raw
  modified_base (319)..(319): a, c, t, g, unknown or other
  modified_base (373)..(373): a, c, t, g, unknown or other
  modified_base (379)..(379): a, c, t, g, unknown or other
  modified_base (502)..(502): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagagcccggggctcagtgaggtctcctgcaagacctctggctacaccttcagtggcaacacgtccactgggtncgccaggcccctggacaggcctgagtgatggatggttgctgagactggtgccgnaaattntgcacgaggtagtttcggggcaggggtcagtcagtcggaccggggacacggtccatcgaccacaacttacagtaggactgaccagtctgactattgacgtacaccggcctctaagttctagtncgacagaacgcgg

SEQ ID NO: 433972 - DNA, 626 bp, Homo sapiens
  misc_feature: GZ8MTXP02G2LLO.51.12.B01.1.454.CMB.2.raw
  modified_base (270)..(270): a, c, t, g, unknown or other
  modified_base (467)..(467): a, c, t, g, unknown or other
  modified_base (595)..(595): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtcncctgcaagacctctggctacaccttcagtggcaacaacgtccacgtgggtcgcgccaggcccctggacaagggcccttgacgtggatggggattgggttgtcgtaggagaaacgttgggtagcccgtacaaaagttctagcacgaggtaggtttcgggggctaggggtaccagtcgaagttgggaacccggggaacncggttaccacgtaccgcccaaactaaccgtttaacgacgttacgggaaacctcggaaccgtaacgtccgtaggaccttacgtttacggaccgaacgacccggggtccgttaccctaagtttaacccgngttacggaccgaacgaggaaacggcccgggg

SEQ ID NO: 433973 - DNA, 609 bp, Homo sapiens
  misc_feature: GZ8MTXP02JAIM1.51.12.B01.1.454.CMB.2.raw
  modified_base (284)..(284): a, c, t, g, unknown or other
  modified_base (291)..(291): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcgagtgaaggtctcctgcaagacctnggctacnccttcagtgacaacacgtccacgtgggtcgccgccacggcccctaggacaagggccttagagtggatgggattgggtttagctggagtacgtgggtcgccgataaattagtgacacgagggtaggttcggggcgtagggtcagtcgagtacgggaacccggggacaccggtaccacgtccggaccctaacgtaacgttaacgacgtacggaaacttcgaaccgtaggttcctaggtaacttacggtttacgaaaccgtaccgtaccggtccgttactaacgtttaccgtggtacgaccgtacgaagggaacgccgggg

SEQ ID NO: 433974 - DNA, 603 bp, Homo sapiens
  misc_feature: GZ8MTXP02JKSIO.51.12.B01.1.454.CMB.2.raw
  modified_base (286)..(286): a, c, t, g, unknown or other
  modified_base (294)..(294): a, c, t, g, unknown or other
  modified_base (297)..(297): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctggaggtgaagaggcccggggctcgagtgaggtctcctgcaagcctntggctacnctnagtcgcaacacgtccacgtgggcgcgccaggcccctagggacagggccttggagtggagtggggattgggtttgctaggaagtacgtgggtcgcccgtataaattgtacggtaccgaacggtaggggtaggtttcgggggacgtaaggggtctagtacgaggtacggggaacccggggacgtaccggtaccacgtcccggacccaactaaccgtaacagtacggaactcgacagtctagactagttagaaccgtacgaccggtccgttacgtaagttacgtcgtcgacgaacgacggacggacggg

SEQ ID NO: 433975 - DNA, 630 bp, Homo sapiens
  misc_feature: GZ8MTXP02ICHOF.51.12.B01.1.454.CMB.2.raw
  modified_base (281)..(281): a, c, t, g, unknown or other
tcagcgatcgtatacacgaccggtgctcgatttagtagtgtagattccgcgggcacgaccggtgctcgatttgtagtgtagattccgcgggggagcatcaccccagcaaccacatctgtcctctagacgaaccccctgagagccccgctcctcaccatggactggacctggaggatcctcttcttggtggcagcagccacaagacgcccactcccaggtgcaggtggtgcagtcgtggggctggaggtgaagaacggcccggggctcgagtgaggtctccngcaagacctcgtggctaccaccttcagtgcaacaacgtccacgtgggtgcgccacggcccctggacaggggccttggacgtggagtgggtattgggtttagtcgtagaggtaacttggggtcgccgtactaaattagtcgactacgagggtacggtttcgggggacgtaggggtcagtcgagtcgggaacccggggactaccggtccacgtccgacccaacgtaacttacgagtacggaactacgaaccctagtactacgaacttacgtttacggaaccgtaccgtaccgggtacccgttactaacgtttacgtcggttacgaccggtaaccgaagggaacggccgggg

SEQ ID NO: 433976 - DNA, 582 bp, Homo sapiens
  misc_feature: GZ8MTXP02JJ80Z.51.12.B01.1.454.CMB.2.raw
  modified_base (288)..(288): a, c, t, g, unknown or other
  modified_base (297)..(297): a, c, t, g, unknown or other
  modified_base (411)..(411): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgccccactcccaggtgcaggtggtgcagtcgtggggctggaggtgaagaggcccggggctcgagtgaggtctctgcaagcctgngctacactnagtgacaacacgtcacgtggtcgcgccgacggcccctggaacgagggtccttgagtggagtggggattgggtttgcgtaggacgtaacgtgggtacgaccgtactaaaagttgngacgaacgtagggtacggttcggggctaggggtcagtacgagtacgggacccggggtacaccggtcacgtccgacccaacgtaaacttacagtacggaactcgactagtcctagtactacgttcgaacgtacgaccggtcctataagttcgtgacgacgacgaggacgcgg

SEQ ID NO: 433977 - DNA, 571 bp, Homo sapiens
  misc_feature: GZ8MTXP02FFTX8.51.12.B01.1.454.CMB.2.raw
  modified_base (271)..(271): a, c, t, g, unknown or other
  modified_base (323)..(323): a, c, t, g, unknown or other
  modified_base (392)..(392): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagacgccggggctcagtgaaggtcncctgcaagacctctggctacacctttcagtggcaacaacgtccacgtgggtncgccaggcccctgggaccaaggggcccttggagtgggatggggattgggtttgctgagactggtgccgnaaattatgcacaggagtttcggggacaggggtcagtcagtcggaccggggacacggtccaagtccggaccacctaaacttaccagttacggaaacctgaaccagtcctgacctatttcggaacgtacgaccggtccgttactaacgttacgtggtcgaccgacgaaggaacggccgggg

SEQ ID NO: 433978 - DNA, 673 bp, Homo sapiens
  misc_feature: GZ8MTXP02J1WVZ.51.12.B01.1.454.CMB.2.raw
  modified_base (412)..(412): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctggaggtgaagacggcccggggctcgagtgaggtctcctgcaagcctcgtggctacaccttcagtggacaacacgtccacgtgggtcgcgccacggcccctggacaggggtccttaggagtggagtgggattgggtttagcgtaggagacgtgggtcgaccgactaaatttgngaccgaacggtaggggttacgggtttccgggggactaggggttccagttcgaggttacgggaacccgggggtacaccggtccacgttcccggaccctaactaaaccgttaccgaggttacgggaaccttcgaaaccccgtagggttacctacggtaaccttaggttttaaccggaaccggtaaccgtaacccgggtcccgtttaacttaacgtttacccggtggttacggacccgtaacggtaagggaacggtcccggggg

SEQ ID NO: 433979 - DNA, 595 bp, Homo sapiens
  misc_feature: GZ8MTXP02G1W43.51.12.B01.1.454.CMB.2.raw
  modified_base (273)..(273): a, c, t, g, unknown or other
  modified_base (283)..(283): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagagcccggggctgagtgagtctccngcaagcctcnggctacaccttcagtggacaacaacgtccacgtgggtcgccgccgacggccccctggaacgaagggtccttaggagtggagtggggtattgggtttagtcgtaggagtaacgtgggtacgccgactaaaattctggacaacggtagggtacgggtttcgggggacgtaggggtcaagtcgagtcgggaaccggggacacggtccagtccgaccaactaactacagtacggactcgacctagtctagactagttcgaaccgacgaccggtccgttataacgttacgtcgtacgacgtaacgaggaacgccggg

SEQ ID NO: 433980 - DNA, 528 bp, Homo sapiens
  misc_feature: GZ8MTXP02IK2AJ.51.12.B01.1.454.CMB.2.raw
  modified_base (269)..(269): a, c, t, g, unknown or other
  modified_base (278)..(278): a, c, t, g, unknown or other
  modified_base (285)..(285): a, c, t, g, unknown or other
  modified_base (310)..(310): a, c, t, g, unknown or other
  modified_base (366)..(366): a, c, t, g, unknown or other
  modified_base (378)..(378): a, c, t, g, unknown or other
  modified_base (425)..(425): a, c, t, g, unknown or other
  modified_base (505)..(505): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgagctcngcaagcctnggctacncttcagtgacaacacgtcagtggtncgccaggcccctggacaggccttgagtggatggattggttgtctgagtacgttggngccgataaattngcacgagggtacgtttcggggctagggtcagtcagtcggaccggganaccgttcagtccgaccaacaacttacagtcgaactgaaccagtcagactattacgacgacgaccgtcgtactaacgttcncgtcgacgtacacggaacgcggg

SEQ ID NO: 433981 - DNA, 627 bp, Homo sapiens
  misc_feature: GZ8MTXP02F08QB.51.12.B01.1.454.CMB.2.raw
  modified_base (324)..(324): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtgtgcagtctggggctgaggtgaagacgcccggggctcagtgaaggtctcctgacaagacctcgtggcctacaccttcaggtcgacaacaacgtccagtgggngccgccgacggcccctaggacaaggggccttagaggtggagtggggattgggtttgcgtagagtaacgtggtcgaccgactaaattagtgacaggtagggtaggttacgggggcgtaggggtcagtcgagttacgggaacccggggacaccggtccgaacgttacccggaccaaacctaaccttaacgacgttacgggaaaccttacgaacctagttacgtacgtacttacgtttacggaccgtaccggacggtcccgttacttaacgttacgtgtacggacgaacgaagggacggaccgggg

SEQ ID NO: 433982 - DNA, 521 bp, Homo sapiens
  misc_feature: GZ8MTXP02JN55A.51.12.B01.1.454.CMB.2.raw
  modified_base (322)..(322): a, c, t, g, unknown or other
  modified_base (391)..(391): a, c, t, g, unknown or other
  modified_base (437)..(437): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactccccaggtgcaggtggtgcagtctggggctgaggtgaagagcccggggctcagtgaaggtctcctgcaagacctctggctacaccttcagtggcaacaacgtccactgggtncgccagcccctggacagggccttgagtgatgggattgggtttgctgagaactgggtgccgacaaaattntgcaacgaggtagtttcggggcaggggtcatcagtggaccgggganacgtcatcgaccaacaacttacatggaaactgacctagtctgactattgacgacacggctctaagtctgtgcgacaggaagcgg

SEQ ID NO: 433983 - DNA, 576 bp, Homo sapiens
  misc_feature: GZ8MTXP02G790C.51.12.B01.1.454.CMB.2.raw
  modified_base (265)..(265): a, c, t, g, unknown or other
  modified_base (278)..(278): a, c, t, g, unknown or other
  modified_base (287)..(287): a, c, t, g, unknown or other
  modified_base (297)..(297): a, c, t, g, unknown or other
  modified_base (319)..(319): a, c, t, g, unknown or other
  modified_base (323)..(323): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgcccactcccaggtgcaggtggtgcagtcgtggggctggaggtgaagacggcccggggctnagtgaaggtctcngcaagcctngctacacctnagtgacaacacgtcacgtggcncgcncggccctggacgaggctgagtggatgggattggttgtcgtaggacgtacgtggtcgcgataaattgtgaccgaggtagggtaggtttcgggggactaggggtctagtcgagtcggacccggggtactacggtcacgtccgacctaacgaacttacgagtaggaaccgtacgacgtacgtctacgtactacgttacgacgtacgaccggtcgttactaagtttacgcggtacgacgacgtacgggaacgtcggg

SEQ ID NO: 433984 - DNA, 592 bp, Homo sapiens
  misc_feature: GZ8MTXP02IJAZH.51.12.B01.1.454.CMB.2.raw
  modified_base (284)..(284): a, c, t, g, unknown or other
  modified_base (402)..(402): a, c, t, g, unknown or other
  modified_base (409)..(409): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaaggcccggggctcagtgaaggtctctgcaagcctntggctacaccttcagtgacaacaacgtccagtgggtgccgccgacggcccctaggacaagggtccttaggagtggagtggggtattgggttagtctggaagtacgtgggtcgccgtanaaattgngacacgagggtcggtttacggggctagggtcaagtcgaagtcggaaccggggacacggttaccacgtccgaccctaacgtaaccttacgagtcggaactcgaacctagtctagtactactttacggaacaccgaccggtcgttactaagtttacgacggtcgacgacgaacggaacggacggg

SEQ ID NO: 433985 - DNA, 515 bp, Homo sapiens
  misc_feature: GZ8MTXP02IGB58.51.12.B01.1.454.CMB.2.raw
  modified_base (226)..(226): a, c, t, g, unknown or other
  modified_base (283)..(283): a, c, t, g, unknown or other
  modified_base (289)..(289): a, c, t, g, unknown or other
  modified_base (293)..(293): a, c, t, g, unknown or other
  modified_base (312)..(312): a, c, t, g, unknown or other
  modified_base (350)..(350): a, c, t, g, unknown or other
  modified_base (364)..(364): a, c, t, g, unknown or other
  modified_base (373)..(373): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtncagtctggggctgaggtgaagacggcccggggctcgagtgaggtctctgcaagcctngctacncttnagtgcaacacgtcagtggncgcgagcccctggacaggcttgagtggatggatggttnctgagtactggtcncgtataatngacacgaggtagttgggcagggtcatcgagtcggaccgggacacgtacactccgaccacacttacacgtaggactgacctagtctgactattacgacgtacgacggtcctactaagttacgtgtacgcgacacggacgacgg

SEQ ID NO: 433986 - DNA, 685 bp, Homo sapiens
  misc_feature: GZ8MTXP02GMTO9.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtgggctggaggtgaagacggcccggggctcgaggtgaggtctcctgacaagcctcgtggctacaccttcgagtggacaacgaacgtccacgtgggtcgccgccacggcccctggaacgagggccttaggagtggagtgggattgggtttagctaggaagtacgtggggtacgcccgtaataaaattgtagaccgaagaagggttcgggtttacgggggccgtaggggtactacgtacgtagtaccggggacccggggtaacgaccgttccgaacgttacccgggaccctaaacccgtaaactttacgaacgtaacgggtaaaccttcggaaacccgtacggtactacggtaaccttagtttacggaaccggttaccgaccggggtaccccgtttattaaacgtttccgttagggtaccggaacggaaccgtaaagggaaacggggacccgggg

SEQ ID NO: 433987 - DNA, 571 bp, Homo sapiens
  misc_feature: GZ8MTXP02F76CU.51.12.B01.1.454.CMB.2.raw
  modified_base (239)..(239): a, c, t, g, unknown or other
  modified_base (255)..(255): a, c, t, g, unknown or other
  modified_base (282)..(282): a, c, t, g, unknown or other
  modified_base (424)..(424): a, c, t, g, unknown or other
  modified_base (441)..(441): a, c, t, g, unknown or other
tcagcgatcgtatacacgaccggtgctcgatttagtagtgtagatttcgcgggggtgggtccaggaggcagaactctgggtgtctcaccatggcctggatccctctacttctccccctcctcactctctgcacaggctctgaggcctcctatgagcttgacacagtccaccctggtgtcagtcgtccccaggaccagacggccaggatcgacctgctctggagatgcattgccaaacgntatgcttatggtaccngcagaagcggcaggccctgtgtacggnatgtataaagacactgagaggccctcgaagggactcccgtagacgcgtattcaccgttggctcgaggttcagggacacggggtcactagttcggcctatcgagtggactacccgaggacagtagggacgaggctggattatnttacgtacaattcaaanagactacgtagttagtactttagtcgttacgttacgactcgacgtaaccgtacggtaccgtaccgttacgtacggtaccaccgaacccgaacgtaccccaacccgtcgtaccgtactaccttccgttccg

SEQ ID NO: 433988 - DNA, 683 bp, Homo sapiens
  misc_feature: GZ8MTXP02GOVO8.51.12.B01.1.454.CMB.2.raw
tcagcgatcgtatacacgaccggtgctcgatttagtagtgtagattcccgggggtgggtccaggaggcagaactctgggtgtctcaccatggcctggatccctctacttctcccctcctcactctctgcacaggctctgaggcctcctatgagctgacacagcccaccctcggtgtcagtcgtcccaggacagacggccaggatcacctgctcgtggagatgctattcgaccaaacgatatgtcttagtcgtaccagcagaacgccgggcacggccctgtgttggtgatagtaataaagacatggagacggcctgagggactccgtgagcgtattctcgtcggctacgaggtacgacgggaacaacggtcacgtagttcggacctagtcgagtggacgtcgaggacgaggagggacgaggctaggtacttagttacgttgtactaaattacaaacgtacgaactacccgttaagttacgggttaactttagttacggtttaccgttacggtaaccgttacgggaacccgtaaaaccggtaacgggttaccgtaccccgggtttaccggtaccgggggttacccaaacccgggtaaccccgaaaacccggggtaacccccgaaacccccttaaccggttccggttaccctaacccgtttcccgtttacccgggtttcccccccg

SEQ ID NO: 433989 - DNA, 557 bp, Homo sapiens
  misc_feature: GZ8MTXP02HGZ3U.51.12.B01.1.454.CMB.2.raw
  modified_base (287)..(287): a, c, t, g, unknown or other
  modified_base (293)..(293): a, c, t, g, unknown or other
  modified_base (297)..(297): a, c, t, g, unknown or other
  modified_base (319)..(319): a, c, t, g, unknown or other
  modified_base (343)..(343): a, c, t, g, unknown or other
  modified_base (380)..(380): a, c, t, g, unknown or other
  modified_base (398)..(398): a, c, t, g, unknown or other
  modified_base (426)..(426): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggagatcctcttcttggtggcagcagccacaagacgccccactcccaggtgcaggtggtgcagtcgtggggctgaggtgaagacggcccggggctgagtgaggtctctgcaagcctgngctacncttnagtgacaacacgtcacgtggcncgcacggccctggacaggcctagngtgatgggattggttgctgagagtgtgccataaatgngacagaggtagttcgggntagggtcagtcgagtacggaccgggtanccgtacactccggaccaactaacgtttaccagttacggaaacctcggaaccctaggttcacggtacctagttcggaaccgtaccgaccgggtccttactaagttaccgtgtcgacgaacgaggaacggcgg

SEQ ID NO: 433990 - DNA, 580 bp, Homo sapiens
  misc_feature: GZ8MTXP02F15C5.51.12.B01.1.454.CMB.2.raw
  modified_base (288)..(288): a, c, t, g, unknown or other
  modified_base (414)..(414): a, c, t, g, unknown or other
  modified_base (509)..(509): a, c, t, g, unknown or other
  modified_base (559)..(559): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcagggtggtgcagtcgtggggctggaggtgaagacggcccggggctcagtgaggtctcctgcaagacctntggctacaccttcagtggcaacacgtccacgtgggtcgcgccgacggcccccgtggacgaaggggcccttggagtggattggggattgggtttagctggacgtaacgtggtacgccgataaagttntgacacgagggtaggtttcggggctagggtcagtacgagtcggacccggggacaccgtccatccgaccactaacttacagttcggaactgaccgngtcctagactagtttcgaacgtacgaccggtccgttacttaacgttacgngtacgacgacaggaacgccgg

SEQ ID NO: 433991 - DNA, 744 bp, Homo sapiens
  misc_feature: GZ8MTXP02JLMRG.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaacccctgagacgccccgctcctcaccatggactggacctggaggatcctcttcttggtggcagcagccacaagacgccccactcccaggtgcgaggtggtgcagtcgtgggcccccctggaggtgaaggaacggcccggggccctcgagtgaaggtctccgtgcaacgacctcgtcggctaccgtaccttcagtcggtacaacaacgtccacggtcgggtcggaccgccgacggccccgtcggacgaagggccgttcggagtacgggtagtaggggtagttgggtttagttcgtaggaagtaacgtgggtcggccgacgtaaaaatttgtacggaccaacggaggggttacgggttttcgggggcgtaacgggggttacctagtacgtagttacgggaacccgggggactaccgggttacccacgttcccggaacccctaaacgttaaaaccgttaccgaagttaaccggggaaacttacgggaaaccctaacgggtttccctaaggtaaccgttaacgtttaccgggaaaccggttaaacccgaaccgggttcccgttaactttaacgtttccgtacgggttacgacccgaagaaccggtaaacggcccggggg

SEQ ID NO: 433992 - DNA, 592 bp, Homo sapiens
  misc_feature: GZ8MTXP02HZDY9.51.12.B01.1.454.CMB.2.raw
  modified_base (198)..(198): a, c, t, g, unknown or other
  modified_base (275)..(275): a, c, t, g, unknown or other
  modified_base (286)..(286): a, c, t, g, unknown or other
  modified_base (322)..(322): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccanaagagcccactcccaggtgcaggtggtgcagtcgtggggctggaggtgaagagcccggggctcgagtgaggtctccngcaagcctcgnggctacaccttcagtgacaacaacgtccacgtgggncgccacggcccctaggacaagggtccttggagtggatgggattgggtttagtcgtagaacgtaacgtggggtgaccgtacgtaaattagtcggacgacgtagggtacgggtttacgggcgtagggtcagtacagtacggaccgggacgacgtacacgtcgaccactaactacagtacggaactcgaacacgtctacgtactagtttacgacgtaccgtaccggtcctacgttaacgttacgtcgtacgacgtaacgacggtaacggcggg

SEQ ID NO: 433993 - DNA, 731 bp, Homo sapiens
  misc_feature: GZ8MTXP02GOWKH.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcgagggtggtgcagtcgtggggctggaggtgaagaacggcccggggcctcgaggtgaacggtctcctgcaacgacctcgtggcctaccacctttcagtcggacaacaccgtccacgtgggcgccgccacggccccctaggaccgaggggtcctaggaggtggagtggggtagtttgggtttagtcgtaggaaggtaacgttggggtacgaccgtaactaaaagtttagtacgacgtaacggtaggggttacggggtttacgggggaccgtagggggtacctaagttaccgaacggttaccgggaacccgggggaccgtacccgggttacccacgttacccggaccctaaacctaaaccgttaacgtaacgtaacggtaaccgttaacgaacccgtagttacccgtaggtaaccttaacgttttaaccggaaccggtacccgtaaaccgggtcccgttacgttaacgtttaccgtaggttaccggtaccgaacggaacggtaacggaccgggg

SEQ ID NO: 433994 - DNA, 598 bp, Homo sapiens
  misc_feature: GZ8MTXP02IZMWP.51.12.B01.1.454.CMB.2.raw
  modified_base (235)..(235): a, c, t, g, unknown or other
  modified_base (281)..(281): a, c, t, g, unknown or other
tcagcgatcgtatacacgaccggtgctcgatttagtagtgtagattcccgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctggagatgcattcgaccaaacgntatgctttagtcggtaccagcagacgccggcacggcctgtgttggnatagaataaagacagtgaagacggcctaggacggactccgtgacgcgtatccgtcgtccgcctccgaggtccgaagggaccaacgggtccaatcgttcggaccagtccgaggtcggaacgtccgaagcgaggacggacgagtcaggtacttattagtagtacaaatacgaactagaccactagttacgtattagtgttactacggtaactcggacgtaaccgtaaggtccgtaacccgtcggtacggtacgacccgtacccaacggaacccctaacccccgtagtacccggtacctcctccgttacccgttcccccg

SEQ ID NO: 433995 - DNA, 594 bp, Homo sapiens
  misc_feature: GZ8MTXP02HPES3.51.12.B01.1.454.CMB.2.raw
  modified_base (340)..(340): a, c, t, g, unknown or other
  modified_base (496)..(496): a, c, t, g, unknown or other
  modified_base (574)..(574): a, c, t, g, unknown or other
  modified_base (580)..(580): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgcccactcccaggtgcgaggtggtgcagtcgtggggctggaggtgaagacggccccggggctcgaggtgaacggtctccgtgcaacgccctgtcggctaccaccttcgagtcggacaacacgtccacgtgggtcnccgccgacggcccctggacgtagggccttaggagtggagttgggtagttggttcgtcgtagagtacgtggtacgccgtaactaaattgcgacgacggtaggggttcggttcggggactagggtctagtcgaggtaccgggacccgggactaccgtnacgtccgaccaactaactacgagtacggactacggactagtctagcttagtacgaccgtcgcggttctataagtacgnggtacncgaacgagacggcg

SEQ ID NO: 433996 - DNA, 568 bp, Homo sapiens
  misc_feature: GZ8MTXP02HAE50.51.12.B01.1.454.CMB.2.raw
  modified_base (289)..(289): a, c, t, g, unknown or other
  modified_base (319)..(319): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtgggctgaggtgaagacgcccggggctcagtgaaggtctctgcaagcctctgctacnccttcagtggcaacacgtccacgtgggtcncgccacggcccctggacagggcctgagtgagtggattgggttgcgtagagaccgtggtgccgataaattgtcgcacgagggtaggtttcggggacgtaggggtacagtcgagtacggaacccgggggacacggttccagtccgaccaacgtaagttacagtacggaactgaccagtcagtactacgttagaaccgacgaccggtcctacgttaacgttacgtggtacgcgaacgaacggaacggccggg

SEQ ID NO: 433997 - DNA, 585 bp, Homo sapiens
  misc_feature: GZ8MTXP02F5MF1.51.12.B01.1.454.CMB.2.raw
  modified_base (292)..(292): a, c, t, g, unknown or other
  modified_base (299)..(299): a, c, t, g, unknown or other
  modified_base (304)..(304): a, c, t, g, unknown or other
  modified_base (326)..(326): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcagggtggtgcagtcgtggggctggaggtgaagacggcccggggctcgagtgaaggtctcctgcaagacctgnggctacnccttnagtgcaacacgtccagtggtcnccgccgcggcccctggacaagggccttggagtggatggggattggtttcgctggaagtaccgtgggtcgaccgataaattatgacacgagggtaggtttcggggcgtaagggtctagtcgagtcgggaccgggacacgtccatccgaccaactacttacagtacggaactcgaactacggtcagtactacgtttcgaaccgtacgtaccgggtccttactaacgttccgtagtcggaccgaacgaaggaacggccgggg

SEQ ID NO: 433998 - DNA, 589 bp, Homo sapiens
  misc_feature: GZ8MTXP02FXVAI.51.12.B01.1.454.CMB.2.raw
  modified_base (273)..(273): a, c, t, g, unknown or other
  modified_base (283)..(283): a, c, t, g, unknown or other
  modified_base (509)..(509): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctgaggtgaagacgcccggggctcagtgagtctcngcaagacctntggctacacttcagtggacaacaacgtccagtgggtcgcgccgacggcccctggacgaagggccttgagtggagtggggattgggtttagcgtagagtaacgtgggtgaccgtataaaattgtcgacacgtagggtagggtttcggggcgtagggtcagtacagtacgggaccggggtacacgtccacgttccgacctaactaacttacgagtacggaactgaccnggtctagactacgttacgaacgaccgacggtccgttacttaacttaccgtggtacggaccgaagaacggaacggccgggg

SEQ ID NO: 433999 - DNA, 577 bp, Homo sapiens
  misc_feature: GZ8MTXP02GZ301.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagacggcccggggctcagtgaaggtctcctgcaagacctctggctacaccttcagtggcaacaacgtccacgtgggtgccgccacggcccctggacagggccttgagtggagtgggattgggttgtcgtgagtaacgtgggtagccgacgtaaagttatagcgacgagggtagtttacggggcgacgggtacgagtacgagtacggaccggggacgaccgtcgactcgaccacaacgttacagtcggactacgacacgtctacgactacgttcgaacgaccgaccggtccgtactaacgttacgtacgtcgaccgacaacggacggaccgg

SEQ ID NO: 434000 - DNA, 643 bp, Homo sapiens
  misc_feature: GZ8MTXP02H5KLU.51.12.B01.1.454.CMB.2.raw
  modified_base (286)..(286): a, c, t, g, unknown or other
  modified_base (321)..(321): a, c, t, g, unknown or other
  modified_base (400)..(400): a, c, t, g, unknown or other
  modified_base (611)..(611): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagagcccactccccaggtgcaggtggtgcagtctggggctggaggtgagaagcccggggctcagtgaggtctcctgcaagaccctntggctacaccttcagtggcaacacgtccacgtggncgccagcccctggacaggccttgagtggagtgggattgggtttgcgttagagtaactgggtcgaccgtactaaaagttntgacaacgaagggtagggttttccgggggactaagggggttccaagttcgaacgttacggggaacccgggggtactaccgggttccaagttcccgggacccaaccgtaaaactttaccgtaagtacggggaaccttcggaaccaacgggtttcccaggtaaccttagtttaccggacgaaccgtaccggttcccgtacgttaaatttccgngttacggaccgaacctaagggaaccgtccggg

SEQ ID NO: 434001 - DNA, 654 bp, Homo sapiens
  misc_feature: GZ8MTXP02G4YGP.51.12.B01.1.454.CMB.2.raw
  modified_base (285)..(285): a, c, t, g, unknown or other
  modified_base (310)..(310): a, c, t, g, unknown or other
  modified_base (335)..(335): a, c, t, g, unknown or other
  modified_base (452)..(452): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgcccactcccaggtgcgaggtggtgcagtcgtggggctggaggtagaaggacggcccggggctcgaggtgaaggtctccngaccaagcctgtggcctactacctnagtgacaacgacgtcacgtgggtcnccgccgacggccccgtaggaccgtaagggtcccttagggacgtgggtaacggtggggttattggggtttacgtcgtagggtaacggtaaccgttggggtcaccggtaataaagtttncggactacggtaggttagggttacggggacgtaggggtactagtacgagtacgggaccgggtacacggtccacgtccgacctaactaacttacgacgtacggtaacctcggaaccctaggttacccagtaactacggttacgaaccgtaccgaccggtaccttaccgtaagtttacggcgtacgacgacgaacggacggcgg

SEQ ID NO: 434002 - DNA, 737 bp, Homo sapiens
  misc_feature: GZ8MTXP02JRYJJ.51.12.B01.1.454.CMB.2.raw
  modified_base (308)..(308): a, c, t, g, unknown or other
  modified_base (339)..(339): a, c, t, g, unknown or other
  modified_base (395)..(395): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcagggtggtgcaggtcgtgggggctggaggtagaaggaacggccccggggcctcgaggtgaacggtctccgtgcaagacctctggctacnccttcagtggacaacaacgtcacgtgggtcncgaccacggcccctagggacaaggggccttaggagtgggatggggattgggtttancgtaggacgtaaccgtggggtacgaccactaaaagtttcgtacggacctaacggaagggggttaacggggttttccggggggacctaagggggttaccaaacgtttccgaaggttaccgggggaaacccccgggggaactaccggggtccccaagttccccgggaacctaaaccgtaaaccctttacgaacgttacgggaaacccttacggaacccctaaggttacctacggtaaccttaaagtttacgggaacccggaaaccgtaaccccggggtccgtttaacgttaactttaacccggttggtcggaacccggtaacaaaccgggaacggggcccgggg

SEQ ID NO: 434003 - DNA, 590 bp, Homo sapiens
  misc_feature: GZ8MTXP02FLMFI.51.12.B01.1.454.CMB.2.raw
  modified_base (272)..(272): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctgaggtgaagagcccggggctcagtgaaggtcnctgcaagacctctggctacacctttcagtggacaacaacgtccacgtgggtcgccgccacggccccctggaccgaagggcccttgagtggagtgggattgggtttagcgtagagtaacgtggtcgccgactaaattgtgacaacgagggtacggtttcgggggcgtaggggtcagtacgagtacgggaccggggacaccggtccagtccgacctaacaacttacagtacggaactcgaccagttcagtacctagtttacgacgaccgtaccgggccttacttaagttaccgtggtacgacgacgaaggaacggccggg

SEQ ID NO: 434004 - DNA, 574 bp, Homo sapiens
  misc_feature: GZ8MTXP02FFPJS.51.12.B01.1.454.CMB.2.raw
  modified_base (552)..(552): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagaagcccggggctcgagtgaaggtctcctgcaagacctctggctacaccttcagtggacaacaacgtccacgtgggtcgcgccgaggccccctgggaccaaggggcccttggagtggatggggatgggtttatcgtagagaactgatcgccgacaaattatgacacgagggtagtttcgggggcaggggttcaatcgagtcggaccggggacacgtccagtcgcccaacaacttacagtacggaactgaacccaggtctggactatttacggaccgtaccgacggtaccgtcgtaacgtttacncgtcgacgaacgaggaaacggg

SEQ ID NO: 434005 - DNA, 644 bp, Homo sapiens
  misc_feature: GZ8MTXP02JZWE0.51.12.B01.1.454.CMB.2.raw
  modified_base (295)..(295): a, c, t, g, unknown or other
  modified_base (322)..(322): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccaacaagacgccccactcccaggtgcagggtggtgcagtcgtggggctggaggtgaagacgcccggggctcagtgagtctctgcaagcctgtggctacnccgttcagtgacaacacgtccagtggncgccacggcccctggacaggtcctggagtggagtggggattgggtttgtctaggacgtacgtgggtacgccgtataaaattcgtagactaacggtaggggtaacggtttcgggggactaaggggttcaagttaccgaacggttacggggaaccccgggggtaactacccgggtaccgacgtcccggaaccctaaactaaaccgtttacgaacgttacgggaaaccttcgggaaccctaagtccgtacgacgtacgtttacggaaaccgtacgacccggtacttactaagtttacgaggtcgacgaacgtaggaacggtcggg

SEQ ID NO: 434006 - DNA, 672 bp, Homo sapiens
  misc_feature: GZ8MTXP02GF1ZG.51.12.B01.1.454.CMB.2.raw
  modified_base (338)..(338): a, c, t, g, unknown or other
  modified_base (431)..(431): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcagggtggtgcagtcgtggggctggaggtgaagacggcccggggctcgagtgaaggtctcctgcaagacctgtggacctacacctttcgagtcggacaaacgaaccgtccacgtggggtcnccgccgacggcccctaggacgaagggccttaggagtggaagtggggattgggtttagtctaggaagtacgtgggtacgaccgtataaaagttntggacaacggtagggttacgggtttacggggacgtaggggttcagtcgaacgttacggggaacccggggtactacccggtccacgttacccggacccaaacctaaaccgtttacgaacgttacggaaaccttacgacccgtaggtacctagaaccttagtttaacggaaccgtaccggtaaccgggccttaaccgttaagttaccgtaggtaccgacgaccgaaagggaacggtccggggg

SEQ ID NO: 434007 - DNA, 544 bp, Homo sapiens
  misc_feature: GZ8MTXP02F5X0N.51.12.B01.1.454.CMB.2.raw
  modified_base (323)..(323): a, c, t, g, unknown or other
  modified_base (367)..(367): a, c, t, g, unknown or other
  modified_base (394)..(394): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcagggtggtgcagtctggggctgaggtgaagacgcccggggctcagtgaaggtctcctgcaagacctctggctacaccttcagtggcaacaacgtccactgggtncgccaggcccctggacaaggccttgagtgatgggattgggtttnctggagaactggtagccgacaaaattntgcaacgaggtaagtttcgggggctaggggtcagttcagtcggacggggacacgtccatcgccacaacttacataggaactgacctaggtctgactagtttagacgtaccacgtccgtactaagtacttgacgcgacgaggacgtaccgg

SEQ ID NO: 434008 - DNA, 716 bp, Homo sapiens
  misc_feature: GZ8MTXP02HR3JA.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctggaggtgaagacggcccggggctcgaggtgaaggtcctcctgacaagcctctcggctacctaccttcgaggtcgacaaacgaccgtccacgtggggtcgccgccgacggccccgtaggacgaacgggtccttaggagtgggagtggggtaacttgggtttacgctaggacgtacgttgggcgaccgtataaattagcgacgacgtagggtacggtttacgggggacctaggggtactaagtcgaacggttaccgggaaacccgggggtaacctaaccgggttacccaacgtacccggaacccgttaaacctaaacccgtttaacgaacggttacgggaaaccttacggaaacccgtaacgtttacgtacggtaaaccttacgtttacgggaaaccgtaaccggtacccggggttacctttacttaaaccgtttatacggtacggacgtaaaccgaaggggtacccggaaccggggg

SEQ ID NO: 434009 - DNA, 592 bp, Homo sapiens
  misc_feature: GZ8MTXP02HHWJF.51.12.B01.1.454.CMB.2.raw
  modified_base (294)..(294): a, c, t, g, unknown or other
  modified_base (446)..(446): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaacccctgagagccccgctcctcaccatggactggacctggaggatcctcttcttggtgcagcagccacaagacgcccactcccaggtgcaggtggtgcagtcgtggggctggaggtgaagacggcccgggctcgagtgaggtctctgcaagctctggctacactcngtgacaacacgtccagtggtcgcgccgacggcccctaggacgaagggccttggacgtggagtgggattggtttagtcgtaggagtaacgtggggtacgccgtaataaagttatcgcaacggagggtacggtttcgggggacgtacggggttnaacgttcgacgtacggggaacccggggactacggtccacgtaccgactaacacttacgatacggactgacagtctacgcttagtacgacggtactaccgggaccttctaaacgttcgagtacgaccgaaggacggaacggaccggg

SEQ ID NO: 434010 - DNA, 690 bp, Homo sapiens
  misc_feature: GZ8MTXP02JS596.51.12.B01.1.454.CMB.2.raw
  modified_base (451)..(451): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagccccgctcctcaccatggactggacctggaggatcctcttcttggtggcagcagccacaagacgccccactcccaggtgcagggtggtgcagtcgtggggctggaggtgaaggacggcccggggctcgagtgaggtctccgtgacaacgacctcgtcggacctaacctaccctttcgaggtcggaccaaacgaaccgtcccacggtcgggtcgccgccgacggccccgtaggaacgagggtcccttggaggtggagtgggtagttgggtttagtcgtaggacgtacgtgggtacgccgaactaaattcgngactaacggtaggtacggtttcggggacgtagggtacagtacgtaaggtaccgggaccggggtactaccggtaccgacgtaccgacctaaacgtaaccttacgaagtacggaaaccttcggaaaaccctcggttacgtacggtaacctttaacggttacggaacccgggtacgacccggggttccgttacttaacgttaccgtacggtacgaaccggaacgacgggtaacggcccgggg

SEQ ID NO: 434011 - DNA, 563 bp, Homo sapiens
  misc_feature: GZ8MTXP02FF8TH.51.12.B01.1.454.CMB.2.raw
  modified_base (261)..(261): a, c, t, g, unknown or other
  modified_base (271)..(271): a, c, t, g, unknown or other
  modified_base (282)..(282): a, c, t, g, unknown or other
  modified_base (290)..(290): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagcccccgctcctcaccatggactggacctggaggatcctcttcttggtggcagcagccacaagagccccactcccaggtgcaggtggtgcagtctggggctgaggtgaagaggcccgggctnagtgaggtcnctgcaagcctntggctacnccttcagtggacaacacgtccacgtgggtgcgccgaggcccctggacgaagggcctgagtggagtggggattgggtttagctaggaagtacgtgggtcgcccgataaaattatgacacgagggtagtttcgggggctagggtcatcgagtacggaccgggacaccggtcagtccgaccactaacttacagtacggaactcgaccgagtctagactagttacgacgaccgtacggccgttactaagttacgtgtacgcgaacgaggacgacggg

SEQ ID NO: 434012 - DNA, 582 bp, Homo sapiens
  misc_feature: GZ8MTXP02FUO9M.51.12.B01.1.454.CMB.2.raw
  modified_base (290)..(290): a, c, t, g, unknown or other
  modified_base (297)..(297): a, c, t, g, unknown or other
  modified_base (302)..(302): a, c, t, g, unknown or other
  modified_base (324)..(324): a, c, t, g, unknown or other
  modified_base (402)..(402): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcagggtggtgcagtcgtggggctggaggtgaagacggcccggggctcgagtgaggtctcctgcaagcctcnggctacnccttnagtgacaacacgtccagtgggncgccacggcccctggacaggcctgagtggatgggtattgggtttagctaggagtacgtggtcgaccgtataaatttgngacaacggtagggtaggtttccgggggactacggggtacagtcgagtcgggaaccggggacaccggtccagtccgaccaactaaacttacagttacggaactcgaacctagtcctagtactattacgacgtaccgacggtccttactaacgttcgtgtcgacgaacgacggacggacggg

SEQ ID NO: 434013 - DNA, 688 bp, Homo sapiens
  misc_feature: GZ8MTXP02FSGD2.51.12.B01.1.454.CMB.2.raw
  modified_base (261)..(261): a, c, t, g, unknown or other
  modified_base (285)..(285): a, c, t, g, unknown or other
  modified_base (317)..(317): a, c, t, g, unknown or other
  modified_base (345)..(345): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaacgcccggggctnagtgaaggtctcctgcaagcctcnggctacacttcagtgcaacacgtcactggacnccgcgccgtccgagaacggagtcgtagnggagtggtaggtagtttgttcgtgtaaggtaacgtacggttggaccgtacgtaaagttaaagttgacgtacgaacgggtagggtttacgggggttacggaccggggttagtacgtacgtaacgtacggtaacccgggggacccggaaccggttacccgtaccgttacccgggtacccgaaacccgtaaacccttaaacgttaaccgtaggttaaaccggtactaaccgacgttaacggtctacggtaaatttacggttaaacggaaccggtacccgtaccggtcccgttaaattaacgttccggtaggtacccgacgtaaacggaacggacgggaacccgggg

SEQ ID NO: 434014 - DNA, 576 bp, Homo sapiens
  misc_feature: GZ8MTXP02IPL0R.51.12.B01.1.454.CMB.2.raw
  modified_base (287)..(287): a, c, t, g, unknown or other
  modified_base (412)..(412): a, c, t, g, unknown or other
  modified_base (556)..(556): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtgcagcagccacaagacgcccactcccaggtgcagggtggtgcagtcgtggggctggaggtgaagacgcccggggctcgagtgaggtctctgcaagacctgngctacaccttgagtcgaccaacacgtccacgtgggtacgcgccacggcccctaggacgaagggcctggagtggagtgggtattgggttagtcgtaggagtacgtgggtcgaccgataaaatttgngtacgaacgtaggggtacgtttcgggggctaggggtcaagtcgagtcgggaacccgggacacgtcagtccgaccaacgtaacttacagtacggactacgaccagtctagactagttacgacgacgtacggccttataagttcgngtcgacgacgaggacggcgg

SEQ ID NO: 434015 - DNA, 578 bp, Homo sapiens
  misc_feature: GZ8MTXP02FX77A.51.12.B01.1.454.CMB.2.raw
  modified_base (260)..(260): a, c, t, g, unknown or other
  modified_base (269)..(269): a, c, t, g, unknown or other
  modified_base (271)..(271): a, c, t, g, unknown or other
  modified_base (278)..(278): a, c, t, g, unknown or other
  modified_base (284)..(284): a, c, t, g, unknown or other
  modified_base (287)..(287): a, c, t, g, unknown or other
  modified_base (308)..(308): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagagcccggggctnagtgagtcncngcagctngctacnctnagtgacaacacgtcagtgggncgccgacggcccctaggaacagggtccttaggagtggagtggggattggtttagctaggaagtacgtgggtcgcgtactaaagttatcgacgaacgagggttaggttcggggacgtagggtacagtacgagtacgggaccgggacacgtccacgtacgccaactaacgtacacgtacgaactacgaacctagtcgtagactacgtttacgacgtacgtaccggtacgttacttaacgttacgtcgtacgaccgacgacggacggaccggg

SEQ ID NO: 434016 - DNA, 587 bp, Homo sapiens
  misc_feature: GZ8MTXP02JH437.51.12.B01.1.454.CMB.2.raw
  modified_base (298)..(298): a, c, t, g, unknown or other
  modified_base (325)..(325): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctgaggtgaagagcccggggctcgagtgaaggtctctgcaagacctctggctacaccttnagtcggacaacacgtccacgtgggtcncgccaggcccctggacagggcctagagtggagtgggattggttagctaggagacgtgggtcgccgtataaattgtgacaacgagggtaggtttcggggactagggtcagtcgagtacgggaaccggggacacggtaccacgtccgaccctaacgtaaccttacgagtacgaacctcgaaccagtacgtagaactagtttacgaaccgtacgaccggtccgtacgttaattaccgtggtacgaccgacgaaggacggaccggg

SEQ ID NO: 434017 - DNA, 559 bp, Homo sapiens
  misc_feature: GZ8MTXP02HKK09.51.12.B01.1.454.CMB.2.raw
  modified_base (284)..(284): a, c, t, g, unknown or other
  modified_base (405)..(405): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctctgcaagacctcgnggctacaccttcagtggacaacaacgtccacgtgggtcgcgccacggcccctggacgaagggtcccttagagtggatgggattgggtttgctgagtaacgtggtcgaccgataaaagtttncggacaacgtagggtacggtttcgggggactaaggggtcaagtcgagtcggaccgggacacgtcagtcgaccacaacgtacagtggactgaccagtctagactgttacgacgacgacggtctactaagttactcggcgacgacacgaacggcgg

SEQ ID NO: 434018 - DNA, 688 bp, Homo sapiens
  misc_feature: GZ8MTXP02HTDDC.51.12.B01.1.454.CMB.2.raw
  modified_base (331)..(331): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcaggtggtgcagtcgtggggctggaggtgaagaacggcccggggctcgagtgaggtctcctgcaagcctctggctacaccttcaggtcgacaacgaacgtccacgtgggtcncgccgacggcccctaggacgaagggtccttggagtggaagtggggtattgggtttagtcgttaggacgtaacgttgggtcgaccgtaataaaagttacgtacggtaccaaacgggtagggttaacggggtttttaccgggggacgttaacgggggttacaacgttaccgtaacggttacggggaccccgggggtaacacccgggttaccaacgttacccggaccctaaactaaccgtttaacgaacgttacggaaacctcgaacctacggttacctagtacgttacgttacggaaccgtacgaccggtaccgttacttaacgttaccgtagtcgacgacgtaacggaacggccgggg

SEQ ID NO: 434019 - DNA, 677 bp, Homo sapiens
  misc_feature: GZ8MTXP02JFY25.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagccccgctcctcaccatggactggacctggaggatcctcttcttggtggcagcagccacaagacgccccactcccaggtgcagggtggtgcagtcgtggggctgaggtgaagacggcccggggctcgaggtgaaggtctccgtgacaacgacctcgtggcctaccacctttcgagtcggaccaacgaaccgtccgacgtcgggtcgccgcccgacgggccccgtggaaccgaacgggtcccttaggagtggaacgtggggtaatttgggtttagtcgtaggaacgtaccgtggggtacgaccggtaactaaaattagtacgtaccgaacggtaggggttaacgggtttcggggaccgtaggggtacagtacgaggtaccgggaccggggaactaccggtaccagtccgacccaaacgtaacctacgaagttacgacctagacctagtactagtactaacgttacgaaccgaccgtaaccggtccgttacgtaacgtttaacgtcggtacgaccggaacgtaacggacggacccgggg

SEQ ID NO: 434020 - DNA, 690 bp, Homo sapiens
  misc_feature: GZ8MTXP02FGO28.51.12.B01.1.454.CMB.2.raw
  modified_base (272)..(272): a, c, t, g, unknown or other
  modified_base (284)..(284): a, c, t, g, unknown or other
  modified_base (317)..(317): a, c, t, g, unknown or other
  modified_base (377)..(377): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctgaggtgaagacgcccgggctcgagtgaggtcncctgcaagcctnggctacaccttcagtgcaacacgtcacgtgggnccgccgacggcccctagggaccaaggggtccttggagtggacgtggggacttgggtttancgtggaagtaaccgtgggttacgaccgtaactaaaagttgtaggaccaacgtaaggggtaacgggttttccgggggaccgtaagggggtacctagttaccgaaggttaccggggaacccgggggaacctacccggttaccccgaagttaccccgggaacctaacccgtaaaaccgtttaccgaagtttacgggaaaacctcggtaaacccgaagttacccgtaaggtaccttaagtttaacggaccgtaaccgtaaccgggtcccttacgtaacttacgttcggtacgacgaacgaacggaacggtaccgggg

SEQ ID NO: 434021 - DNA, 542 bp, Homo sapiens
  misc_feature: GZ8MTXP02HS7B2.51.12.B01.1.454.CMB.2.raw
  modified_base (271)..(271): a, c, t, g, unknown or other
  modified_base (279)..(279): a, c, t, g, unknown or other
  modified_base (286)..(286): a, c, t, g, unknown or other
  modified_base (291)..(291): a, c, t, g, unknown or other
  modified_base (315)..(315): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaggtctcngcaagctntgctacnccttnagtggcaacaacgtccagtgggtncgccaggcccctggacaagggcctgagtggatgggattgggttgctgagacgtggtcgccgacaaattgtgcaacgagggtaggtttcggggactaggggtcagtcagtggaccggggacacgtccatccgaccacaacttacagtacggaactcgacagtctagactagtttcgaacgtaccgacggccgtataacgtacgtgtacgcgaacgaggaacggccggg

SEQ ID NO: 434022 - DNA, 636 bp, Homo sapiens
  misc_feature: GZ8MTXP02IJVUW.51.12.B01.1.454.CMB.2.raw
  modified_base (280)..(280): a, c, t, g, unknown or other
  modified_base (333)..(333): a, c, t, g, unknown or other
  modified_base (417)..(417): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccagggtgcaggtggtgcagtcgtggggctggaggtgaaggacgcccggggctcgagtgaaggtctccngcaagacctcgtggctaccaccttcgagtcggacaacaacgtcacgtgggtcncgccacggcccctggaacagggccttggagtggatggggattgggtttgtctaggaagtaccgtggggtcaccgataaagttancgtacacggtaggtacgggttcggggacgtaggggtacctagtcgacgtacgggacccggggtacacgttccgagtccgaccaacctaacgttaccagtacggaactacgaacctagtcgtacgtactacgtttacggaaccgaccggtaacccggttccgttacttaacgtttaccggtggttaccgaccggaaccgaacgggtaacggccccggggg

SEQ ID NO: 434023 - DNA, 623 bp, Homo sapiens
  misc_feature: GZ8MTXP02GI52O.51.12.B01.1.454.CMB.2.raw
  modified_base (297)..(297): a, c, t, g, unknown or other
  modified_base (323)..(323): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcaaccacaagagcccactcccaggtgcaggtggtgcagtcgtggggctggaggtgaagagcccggggctcgagtgaggtctcctgcaagcctgtggctacaccttnagtggcaacaacgtccagtggggtcnccgccgaggccccctaggaccgaagggtcttggaggtggatggggattgggtttatcgtgagtaacgtgggtcgaccgactaaagttagtgacacgagggtacggtttcgggggacgtacggggtcacgtcgagtcgggaacccggggactaccggtcctacgtaccggacccaacgtaaaccgttacgagttacggaacctacgaccgtagtaccgtacgaccgttagtttacggaaccgacgtaccggtccgttacttaacgttaacgtgtacgaccgacgacggacggaccggacgg

SEQ ID NO: 434024 - DNA, 655 bp, Homo sapiens
  misc_feature: GZ8MTXP02HAMUQ.51.12.B01.1.454.CMB.2.raw
  modified_base (292)..(292): a, c, t, g, unknown or other
  modified_base (304)..(304): a, c, t, g, unknown or other
  modified_base (330)..(330): a, c, t, g, unknown or other
  modified_base (424)..(424): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgccccactcccaggtgcaggtggtgcagtcgtggggctggaggtgaagacggcccggggctcgaggtgaggtctcctgcaagcctcnggctacaccttnaggtcgacaacacgtccacgtgggcnccgccacggcccctggacaagggccttaggagttggacgtggggattgggtttagtcgtaggagtacgtggggtcgacccgtaataaaatttgngaccgaagaggggtaacgggtttcgggggacgtaggggtacctagttacgaggttaccggggacccgggggtaactaccggttaccgaacgttcccggaaccctaaacttaaaccgttaccgaaaggtacggggtaaaccttacgggaaaccctaggtcctaggaccttagtttacgaaccgtacgaccggtccttataacgttcgagtcgacgtaccgaggaacggccgg

SEQ ID NO: 434025 - DNA, 630 bp, Homo sapiens
  misc_feature: GZ8MTXP02GSNUZ.51.12.B01.1.454.CMB.2.raw
  modified_base (277)..(277): a, c, t, g, unknown or other
  modified_base (282)..(282): a, c, t, g, unknown or other
  modified_base (293)..(293): a, c, t, g, unknown or other
  modified_base (296)..(296): a, c, t, g, unknown or other
  modified_base (319)..(319): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttctggtggcagcagccacaagacgcccactcccaggtgcgaggtggtgcagtcgtggggctggaggtgaaggacggcccggggctcgagtgagtctcngacanctcgtgctacnctnagtcgacaacacgtcacgtggcncgccgacggcccgtggacgagggtccttgagtggagtgggtagtttgggttacgtcgtaggacgtacgttgggtacgaccgtaataaagttgtacgacgaacggtagggtacgggtttcggggcgtagggtcagtcgacggtaccgggaccgggactaccggtaccgacgtacccggacctaacgtaaccgttacgacggtaacgtaactacgaacctacggtactacggtacttacgttacggaccgtaccgtaccggtccttacgttaacgttacgtacggtacgacgtaacgacggtaacggaccggg

SEQ ID NO: 434026 - DNA, 638 bp, Homo sapiens
  misc_feature: GZ8MTXP02FJQ5X.51.12.B01.1.454.CMB.2.raw
  modified_base (276)..(276): a, c, t, g, unknown or other
  modified_base (441)..(441): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaaggacggcccggggctcgagtgaaggtcncctgcaagcctctggctacaccttcagtcgacaacaacgtccacgtgggtgccgccgacggccccgtggaacaagggcctgagtggagtgggattgggtttagctaggagtaacgtgggtcgccgactaaattgtcgacaacggagggtaacgggtttccggggngtaaggggtactagtacgagtacgggaccgggggaactaccggtacctacgtccgaccctaaccgtaaacttacgagtaacgggtaaccttaggaccctagtaccgtagtaacctacgtttacggaaaccgtaccgtaccgggtacccgttacttaacgttaccgtggtacgacggaacgaacggaacggtccgggg

SEQ ID NO: 434027 - DNA, 562 bp, Homo sapiens
  misc_feature: GZ8MTXP02IAMO4.51.12.B01.1.454.CMB.2.raw
  modified_base (278)..(278): a, c, t, g, unknown or other
  modified_base (387)..(387): a, c, t, g, unknown or other
  modified_base (395)..(395): a, c, t, g, unknown or other
tcagcgatcgtatacacgaccggtgctcgatttagtagtgtagattccgcgggcacgaccggtgctcgattttgtagtgtagattccgcgggggagcatcaccccagcaaccacatctgtcctctagacgaaccccctgagagccccgctcctcaccatggactggacctggaggatcctcttcttggtggcagcagccacaagacgcccactcccaggtgcagggtggtgcagtcgtggggctgaggtgaagaggcccggggctcagtgaggtctcngcaagcctgtgctacactcagtgcaacaacgtcacgtggtgcgccacggcccctggacgagggcctgaggtgagtggtatgggtttgcgtgagacgtgggtcgacctanaaattagngcgacgaagggtggtttcggggacgagggtcagtcagtcggaccggggacacggtccagtccgaccaacaacgtacagtaggtaactagaccgagtctagtacctatttacgacgtaccgaccggtccttactaacgttctacggtcgacgacgaacggacggcggg

SEQ ID NO: 434028 - DNA, 665 bp, Homo sapiens
  misc_feature: GZ8MTXP02FQDDK.51.12.B01.1.454.CMB.2.raw
  modified_base (638)..(638): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcagggtggtgcagtcgtggggctggaggtgaagaacggcccggggctcgagtgaaggtctcctgcaagacctcgtggctacaccttcagtcggacaacacgtccacgtgggtcgccgccgacggcccctggaaccgaagggccttaggacggtggagtgggtagttgggtttagtcgtaggaacgtaacgtgggtacgaccgtataaaagttgtacgacaacggtaggggttacgggtttaccgggggacgttaagggggtactagttaccgacggttacggggaaccccgggggaactacccgggttaccacgttacccggacctaaaccgtaaacctttacgaacgttacggaaactacgaaccgtagtactagtactacgttacgaaccgtacgtaccggtccgttataacgttcgnggtacgacgaacgacggacggaccggg

SEQ ID NO: 434029 - DNA, 627 bp, Homo sapiens
  misc_feature: GZ8MTXP02HE6K1.51.12.B01.1.454.CMB.2.raw
  modified_base (439)..(439): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcgagggtggtgcagtcgtggggctggaggtgaaggacggcccggggctcgagtgaacgtctctgcaacgcctcgtggcctaccaccttcaggtcggacaaaccgaaccgtccacgtgggtcgccgcccgacggccccgtaggaacgaggggtccttggagtgggagtgggtattgggtttgtcgtaggaagtacgtggggtcgaccgtaactaaattcgngtacacggtaagggtacgggtttcggggcgtagggtcaagtcgaaggtacgggaccggggactaccgtacgacgtccgaacctaactaacctacgagtacggactacgacctagtcgagtactacgtttacgaaccgtacgaccgtcgttacgtaagtacgtcgtacgacgaacgtaggaacggcggg

SEQ ID NO: 434030 - DNA, 713 bp, Homo sapiens
  misc_feature: GZ8MTXP02I0MGB.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtgcagcagccaacaagacgccccactcccgaggtgcgaggtggtgcaggtcgtggggctggaggtagaaggacggccccggggctcgaggtgaggtctctgacaacgtcctctggcctacaccttcgagtcggaccaaacgaccgtccgtacgtcgggtcgcccggaccgaccgggccccgtagggaaaccgtaaggggtcctttagggaggttcggggagttggggtactttggggtttagtcgtaggaacgtacgttcggggacgaccgtaactaaaagttcgtgacgtaacggaaggggttacgggttcgggggacgtaggggtacagtcgaggtacgggaacccggggactaccgtccgaagtccgtaacctaaacgtaaccgttacgaaggttacgggaaacctcgaaaccgtacgttcgtacgtaacgttactttaccggaaccgtaccggtaccggttaccgttactttaaacgttcggtacggttaacggaccgaaacggtaacgggaacggtcgggg

SEQ ID NO: 434031 - DNA, 673 bp, Homo sapiens
  misc_feature: GZ8MTXP02GYXJN.51.12.B01.1.454.CMB.2.raw
  modified_base (517)..(517): a, c, t, g, unknown or other
  modified_base (639)..(639): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggagatcctcttcgttggtggcagcacgccaacgaagacgccccactcccgaggtcgcgagggtggtgcgtagtcgtggggctggaggtaggaaggaccgggcccggggctacgaggtaggaacggtcctccgtagaccgaaacgtccctcgcggacctaacctacctttcgaggtacggaccaaaccgtaaccgtccacgggttcggcgccggaccgaccggccccgtggaaacgtaggtcctaggagtggaggttaggtagtttacgggtttgtcgtaggtaacggtacgtggtacgaccgtataaattgcgacgaaggtagggttacgggttcggagtacggtanacgtcgaggtacccgggaacggtactacccgtacgacgtacccggacctaaacgacgtacgaagtacggaacctcggaacgtcgtacgtcaacgttacgtcggaccacgtaccgtccgttanaacgtttcgacgtacacggacacggacggaccgg

SEQ ID NO: 434032 - DNA, 691 bp, Homo sapiens
  misc_feature: GZ8MTXP02JZNBL.51.12.B01.1.454.CMB.2.raw
  modified_base (286)..(286): a, c, t, g, unknown or other
  modified_base (293)..(293): a, c, t, g, unknown or other
  modified_base (321)..(321): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagacggcccggggctcagtgaaggtctcctgcaagcctcnggctacncttcagtgacaacacgtccacgtggtcncgccacggcccctggacgaggcctgagtggagtgggattggtttgctaggacgtaacgtgggtcgaccgtactaaaatttgacgaccgtacgtaagggggttacgggtttacgggggactagggggtacctagttaccgaagtaccgggggaaacccgggggtacaccgggtcctaacgtcccggaaccctaaaccgttaaacctttacggaacgttacgggaaactaccggtaaaccctacgggtttacctacggtaaccgttaacgtttaccggaaaccggtaaccggtaacccggggtaccctttacgttaacgtttaccggtacggttacggtaacccggaaacgaacgggaacgggacccggggg

SEQ ID NO: 434033 - DNA, 635 bp, Homo sapiens
  misc_feature: GZ8MTXP02GONL5.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagacgcccggggctcgagtgaaggtctcctgcaagacctgtcggctacaccttcgagtcggacaacacgtccacgtgggtcgcggccacggccccgtggacgaaggggtccttaggagtggaagtggggtaattgggtttacgctaggaaggtaaccgtgggtcgacccgataaaagttagtcggacgacgagggtaacggtttcgggggacgtaggggtccagttacgagttacggaccgggggtactaccggtaccagtccgacctaaactaaccgttacgagtacggaactacgacccgtaagtcgtacgtaactagtttacggaccgtaccgtaaccgggtcccttagtaacgttacgttggacgcgaacacggacggaccgggg

SEQ ID NO: 434034 - DNA, 643 bp, Homo sapiens
  misc_feature: GZ8MTXP02FIPW2.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtctggggctgaggtgaagagcccggggctcagtgaggtctcctgcaagacctctggctacacctttcagtggacaacaacgtccacgtgggtcgccgccgacggccccctggaccgaagggcccttggagtggacgtggggattgggtttagcttggagaacgtgggtacgcccggataaaaagtttagtcggacctaaacggtacgggggtttcggggttacgggacgggtacggtacgtagtacgttaggaccgggggtaaccgaaccggtccgtacgtacgtacccgaccgtaaaccttaacctacgtaggtaaccgacgtaccgacgttacgtcgtactacgtttacgtaacgacgtaccgtaccgtcccgttattaacgtacgtgaccgacgacgaacggtcgacggg

SEQ ID NO: 434035 - DNA, 573 bp, Homo sapiens
  misc_feature: GZ8MTXP02FU5YR.51.12.B01.1.454.CMB.2.raw
  modified_base (273)..(273): a, c, t, g, unknown or other
  modified_base (285)..(285): a, c, t, g, unknown or other
  modified_base (291)..(291): a, c, t, g, unknown or other
  modified_base (296)..(296): a, c, t, g, unknown or other
  modified_base (316)..(316): a, c, t, g, unknown or other
tcagcgatcgtatacacgaccggtgctcgatttagtagtgtagattccgcgggcacggaccggtgctcgatttgtagtgtagattccgcgggggagcatcacccagcaaccacatctgtcctctagagaacccctgagacgccccgctcctcaccatggactggacctggaggatcctcttcttggtggcagcagccacaagacgcccactcccaggtgcaggtgtgcagtcgtgggctggaggtgaagacggccggggctcgagtgaagtcnctgcagacctcngctacnccttnagtgacacacgtcacgtggngcgccgacggcccctaggacgacggccttggagtggagtgggattgggtttgtctggagtaactgggtcgaccgataaatagtgacaacgtagggtaggtttcggggcgtaggtacagtacagtacgggaaccggggacaccgtaccgacgtcgaccaaccgtaaacttacaagttacgaactacgacctagtcgtagactagttacgacgtacgacggtcgtactaacgttacgtgtacgcgaacgagaacgacgg

SEQ ID NO: 434036 - DNA, 777 bp, Homo sapiens
  misc_feature: GZ8MTXP02GU08K.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggaggatcctcttcttggtggcagcagccacaagacgccccactcccaggtgcgaggtggtgcagtcgtggggctggaggtgaaggacggcccggggctcgaggtgaacggtctccgtgaccaagccctcgtcggcctacctaccttgaggttcggaaccaaaccgtaaccgttccgaacggttcggggtacgcccggacccgaacccgggtcccccgtagggaaccgtaaggggtccccgtttagggaggttagggagttggggtatttcggggtttagtccgtagggaacggaaccggttggggtaccgacccggtaattaaaagttgtacggtacgaacgggtaggggttacggggtttaccgggggacgtaacggggttactaacgtacggtaacgggttacccggggaacccgggggtaacctacccgggtacgtaaccgttacccggaaccctaaacccgttaaaccgttaacgaacggtaaccggtaacgttacgggaaccctaggttaccgtacgtaacgttacgtttaacggaacccgtaacgtaccggtcccgttacgttaacgttacgttcggacgacgaacgacggacggaccggg

SEQ ID NO: 434037 - DNA, 616 bp, Homo sapiens
  misc_feature: GZ8MTXP02JELGF.51.12.B01.1.454.CMB.2.raw
  modified_base (303)..(303): a, c, t, g, unknown or other
  modified_base (330)..(330): a, c, t, g, unknown or other
  modified_base (527)..(527): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcagggtggtgcagtcgtggggctggaggtgaagagcccggggctcgagtgaaggtctcctgcaagacctcgtggctacacctttnagtcggacaacacgtccacgtgggtcncgaccacggccccctaggaaccgtaacggggtccctttaggagtaggaaggttggggaagttgggtttagtcgtggaaacgtaacgttggggttacgcccgtaataaaatttgagaccgaagtagggtacggtttcgggggccgaggtcactcgaagtcggaccggggacacggttcactcgccctaacacgtttanaacgtggaactcgaccgtagtcctagactacgttgaaccgtacgaccggtccttactaaagttcgtgtacgacgaacgaggaacggcgg

SEQ ID NO: 434038 - DNA, 668 bp, Homo sapiens
  misc_feature: GZ8MTXP02IHC4D.51.12.B01.1.454.CMB.2.raw
  modified_base (287)..(287): a, c, t, g, unknown or other
  modified_base (318)..(318): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtgcagcagccacaagacgcccactcccaggtgcaggtggtgcagtcgtggggctggaggtgaagaacggcccggggctcgagtgaaggtctctgcaagcctntgctacacttcagtgacaacacgtcagtggncgcacggcccctggacgaggcctaggagtgagtgggattgggtttagtctaggacgtaacgtgggtacgacccgtataaaatttgacggaccgtaacggtaacggggttaacggggttttccgggggacgtaacgggggttccaacgttacgaacggttacggggaaacccgggggtacctaacccggttaccgacgttaccccggaaccctaaaccgtaaaacctttaacgaacgttacgggaaaccttacgaaacccgtaacgttcgtacgtaacttacgtttcggaaaccgtaccgaccggtccgttactaacgttcgtacgtcgacgacgaacggaacggccgggg

SEQ ID NO: 434039 - DNA, 645 bp, Homo sapiens
  misc_feature: GZ8MTXP02HV2Y4.51.12.B01.1.454.CMB.2.raw
  modified_base (436)..(436): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagccccgctcctcaccatggactggacctggaggatcctcttcttggtggcagcagccaacaagacgccccactccccaggtgcaggtggtgcagtcgtggggctggaggtggaggacggccccggggctcgaggtgaggtcctcgtgacaacgacctctggctactaccttcgagtcggacaacaccgtccacgtgggtcgccgccacggccccgtaggacgaagggccttggaggtggaggtggtagttgggtttagtcgtaggacgaacgttgggcgacccgtaataaagtttnacggactacggtaggggtacggtttcgggggactaggggtctaagtacgaggtacgggacccggggactaccggttccgagtcccgaccaaacgtacttacgaggtacggaactcgacctagtcgtagactacgttacggaaccgtaccgtacggtcccgttatttaacgttacggtcggtacgaccgtaacggaggtaacggccgggg

SEQ ID NO: 434040 - DNA, 578 bp, Homo sapiens
  misc_feature: GZ8MTXP02IAN8I.51.12.B01.1.454.CMB.2.raw
  modified_base (273)..(273): a, c, t, g, unknown or other
  modified_base (422)..(422): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaacgcccggggctcagtgaaggtcncctgcaagacctctggctacaccttcagtcggacaaacaacgtccacgtggggtcgccgaccacggcccccgtggaaccgaaggggtccctttaggagtggagtggggattgggtttacgctaggaggtactgggtgaccgataaaatntgcacgaggtaggttcgggcgagggtcagtcgagtacggaccgggacacgtaccagtccgaccaactaacttacagtacggaactcggaacctagtctagactagttacgaccgtacgacggtctactaacgtcgtagtcgacgacgagacggcgg

SEQ ID NO: 434041 - DNA, 569 bp, Homo sapiens
  misc_feature: GZ8MTXP02HW2TV.51.12.B01.1.454.CMB.2.raw
  modified_base (280)..(280): a, c, t, g, unknown or other
  modified_base (288)..(288): a, c, t, g, unknown or other
  modified_base (295)..(295): a, c, t, g, unknown or other
  modified_base (319)..(319): a, c, t, g, unknown or other
  modified_base (488)..(488): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgcccactcccaggtgcaggtggtgcaggtcgtggggctaggaggtgaagacggccccggggctgagtgagtctccngcaagctntgctacnctcagtgcaacgacgtcagtggcncgccacggccctggacgaggcctagagtggagtgggattgggttatcgtagaagtacgtggtcgaccgaataaattgcgacacggtaaggggtcggtttcggggcgtaggggtaccagttcgagtacggggacccgggatacggtccagtccgaccaacgtaacctagngtacggactagacctagtctagactagttacggaactacgaccggtcttacttaagtcgtagcgacgaacaggaacgccgg

SEQ ID NO: 434042 - DNA, 809 bp, Homo sapiens
  misc_feature: GZ8MTXP02J1T40.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggagatcctcttctggtgcagcagccacaagacgccccactcccgaggtgcaggtggtgcagtcgtggggctggaggtagaacggacggcccggggtctacgaggtaggaacggtcctccgtagacctaacgtaccttcgtcggtacctaccgtaccgtttacgaggttacggacctaaacgtaaccggtccctaacggttcggggacgacccggacccggaaccggtcccccgttaggggaacccgtaaggggtcccctttaggggagggttacggggtaacggttggggtaaacggtttggggtttaccggtcggttaaagggtacggtaaaccgttggggtaccgtacccgtaaacgttaaaaagtttcggacgacccgtaagggtaaacggggtttcggggtttaccgggggactacgggggttactaacgggtaccgtaacgggttaccgggggaaaccccggggttcaaacccggttccgacgttaccccggaacctaaacgtaaccgtttaaccgaggtttaacggaacctacggtaaccctggttacctaggtaactacggttaccgaaccggtacgtacccggttaccttagtaaccgtacggtgacggtacaacggacggaaccggtcggg

SEQ ID NO: 434043 - DNA, 718 bp, Homo sapiens
  misc_feature: GZ8MTXP02J02XB.51.12.B01.1.454.CMB.2.raw
  modified_base (197)..(197): a, c, t, g, unknown or other
  modified_base (327)..(327): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttctggtggcagcagccanaagagccccactcccaggtgcagggtggtgcagtctggggctgaggtgaagacggcccggggctcgagtgaaggtctcctgcaagacctcgtggctacaccttcagtggccaacaacgtccacgtgggtnccgcccaggcccctggacgaggcctggagtggatggggattgggtttagctggacgtacgtgggtcgaccgtcaaatttatggtaccgaacggtaggggtaaggggttttccgggggacgtacgggggttacctagttaccgtagggttacgggaccccgggggttaacgacccgggtaccctacgttaccccgggacctaaacccgtaaaccgtttaaaccgaacggttaacggggtaaaccgttaccggaaacccgtaacgggttacctacggtaaaccgttagttttaccggaaacccggtaccgtaacccggggtacccgtttaacccgttaagtttaaccggtcggttacggtaccggaaccgtaaacggggaacggacccggggg

SEQ ID NO: 434044 - DNA, 712 bp, Homo sapiens
  misc_feature: GZ8MTXP02FLWM3.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcagggtggtgcagtcgtggggctggaggtgaagacgcccggggcctcgagtgaaggtctcctgacaagacctctggctaccaccttcagtcggacaacaacgtccaacgtgggtcgccgccgacggccccctaggaccgaaggggcccttaggaggtggagttggggacttggggtttacgtcgtaggaagtaacgttgggtcgcccgataaaagtttctcgacgtacgaggggtacgggtttccgggggacgtaagggggtactacgttacgacggttacggggaacccgggggtacctaccgggtccctaacgttacccgggacccgtaaaacccgtaaaccttttaaccggaaacgtttacggggaaaccttaccgaacccgtaacggttacgtaccggtaaccgttaaacgttttacggaaaccggtaaccgtaacccggtcccgtttattaacttacgtaggtacgacggacgaacggaacggccgggg

SEQ ID NO: 434045 - DNA, 706 bp, Homo sapiens
  misc_feature: GZ8MTXP02FWR5S.51.12.B01.1.454.CMB.2.raw
  modified_base (276)..(276): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagccccgctcctcaccatggactggacctggaggatcctcttcttggtggcagcagccacaagacgcccactcccaggtgcaggtggtgcagtcgtgggctggaggtgaagacggcccggggctcgagtgaaggtcnctgacagcctcgtgctacaccgttcagtcgacaacacgtccacgtggatcgcgccgacggcccctaggacgaacgggtcttaggacgtggagtaggggtatttggggttagcgtaggacgtacgtgggtcgaccgtaactaaagtttgcgacgacggtaaggggtacgggtttccggggacgtaggggttacacgttcggaacggtaccggggaaccgggtaaccgtaccgtccgtaacgtacccggaaccctaactaaaaccgttcgtaaacgttcggaaaaccgttcggaaaccgtaacggttcgtaaacggtaaccttaacgggtttaaccgaaccccgggttaaaccgacccggggtttaccgttaactttaacggttaccgttacggtaccggaacggtaaaccgggtaacgggtaaaccggggg

SEQ ID NO: 434046 - DNA, 762 bp, Homo sapiens
  misc_feature: GZ8MTXP02IY0QU.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcaggtggtgcagtctggggctggaggtgaagacggcccggggctcgagtgaggtctctgcaagacctgtggcctacgccttcagtggacaacacgtccagtcggtcgccgccacggccccctgggaaccaacgggccctttggacggtaggagtggggactttgggtttagtcgttaggaacgtaacgttggggtcgacccgtacgtaaaagttacgtcgaccgtaacggaaaggggttaacgggtttttcgggggaccgtaagggggttacaacgtttaccgaaggttaccgggaacccgggggtaacctaaccgggtttaccgaaccggttacccgtaacccgaaaccggttaaacctttaacggaacgttaaccgggaaaaccgtttaccggaaaccgttaacggtccgttacggtaaaccctttaacgtttaccgggaaaccgtaccggtaaccccgggttacccggtttaccttaaaagttttccgttaacgggtaccgtaacggaaacccggtaagggaaccggggtaacccggggg

SEQ ID NO: 434047 - DNA, 705 bp, Homo sapiens
  misc_feature: GZ8MTXP02JM5GX.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcaggtggtgcagtcgtggggctggaggtgaaggacggcccggggctcgagtgaaggtctcctgcaagacctcgtggctacaccttcgagtggaccaacacgtccacgtggggtcgccgccgacggccccctggacgaagggtcccttaggaggtggaagtggggattgggtttagtcgtaggacgtaacgtggggtacgaccggtaactaaaatttgtagaccgaacggtagggttaacggggtttccgggggaccgtacgggggtctaagtccgtaaggttaccggggaaacccgggggtacctaacccgggttcccaacgttacccgggaaccctaaacccgtaaaccgtttacccgaacgttacggggaaacccttacgggaacccaaggttacctacggaacttacgtttacggaacccgtaccggtaccggtcccgttacttaagttaccgtggtacgacgacgaacgggacggaccgggg

SEQ ID NO: 434048 - DNA, 666 bp, Homo sapiens
  misc_feature: GZ8MTXP02JM4RH.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagccccgctcctcaccatggactggacctggaggatcctcttcttggtggcagcagccacaagagcccactcccaggtgcgaggtggtgcagtcgtggggctggaggtagaaggaaggccccggggcctcgagtggaacggtctcctgacaacgaccgtcgtggctacctaccttcgagtcggacaaacaacgtccgacgtagggtcgccgaccgacggcccgtggaacgaggtccttggagtggagtgggagttggttgtcgtagagacgtggtcgaccataaatagtcagtaacggaggggttacggttcggggacgtagggtaccagtccgaagtaccggggacccggagaccccgtacgtacgccgaacccaaccgtaaacgtttacgacgttaacgggaaccttagggaacctacgttacgtacggacctttaggttaacccggacgtaaccggtacccggtacccgttattaacgttacgtaacggtcggaagaaaccgggtacggaacgggtaaccgggg

SEQ ID NO: 434049 - DNA, 663 bp, Homo sapiens
  misc_feature: GZ8MTXP02HCIWQ.51.12.B01.1.454.CMB.2.raw
  modified_base (287)..(287): a, c, t, g, unknown or other
  modified_base (325)..(325): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctgaggtgaagacgcccggggctcgagtgaaggtctctgcaagacctcnggcctacaccttcagtgacaacacgtccacgtgggtcncgccacggcccctggacgaagggccttagagtggatggggattgggtttagtcgtggagtaacgtgggtacgccgtactaaaatttgtcggaccaacggtaggggtacgggttttcgggggaccgtaaggggttctaacgtcgaacggtcggggaaccccgggggtaactaacccgggttccaacgttccccggaacctaaacccgtaaaccgtttaaccgaagttacgggaaaccttcggaaacccgtagtactacggaccttagtttccgaaaccgtaccgaacccggtccgtacttaacgttaccgtgtacgaccgaacgacggaacgaccgggg

SEQ ID NO: 434050 - DNA, 694 bp, Homo sapiens
  misc_feature: GZ8MTXP02JAV12.51.12.B01.1.454.CMB.2.raw
  modified_base (95)..(95): a, c, t, g, unknown or other
  modified_base (198)..(198): a, c, t, g, unknown or other
tcagcgatcgtatacacgaccggtgctcgatttagtagtgtagattccgcgggcacgaccggtgctcgatttgtagtgtagattccgcgggggancatcacccagcaaccacatctgtcctctagagaaccccctgagagccccgctcctcaccatggactggacctggaggatcctcttcttggtggcagcagccanaagacgcccactcccaggtgcagggtggtgcagtcgtggggctggaggtgaagacgcccggggctcgagtgaaggtctccgtgacaacgtcctcgtggcctactaccttcaggtcggacaacgaaccgtcacgtgggtcgccgccgacggcccctggaaccgagggtcctggagtggagtgggtattagggtttcgtcgtaggaacgtaacgttgggtacgacccggtaaattaaaatttgtacggacctaaagggaggggtttacgggtttcgggggctaacggggtcctaagtccgtaaggtacggggaaccccgggggtaacacccggtttacaaccgttaccgaacccctaaagtaaacctttacaacggttacggaacttaccgaaccgtcggttactacggtaacttaacgttcggaaaccgtaccgtaccgggtcccttaaggttaacgttacgtcggtaacggacgtaaccggaagggacgaccgggg

SEQ ID NO: 434051 - DNA, 655 bp, Homo sapiens
  misc_feature: GZ8MTXP02GLA3C.51.12.B01.1.454.CMB.2.raw
  modified_base (285)..(285): a, c, t, g, unknown or other
  modified_base (291)..(291): a, c, t, g, unknown or other
  modified_base (295)..(295): a, c, t, g, unknown or other
  modified_base (402)..(402): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagacggcccggggctcgagtgagtctctgcagacctcngctacncctnagtgacaacaacgtccagtggtcgccgccacggccccgtaggacgaagggcctaggagtggagtgggattcggttagctaggacgacgttggcgacgacaaagttgngacacggtagggttcggttacggggcgaagggttcaagtacgaacgtcggggaacccgggtaacacccggtaccacgttacccgggaaccctaaaacctaaaccgtttacgaacgtaacgggtaacctacgggaaacctagtaccgttaacgaaacgttacggtttaacggaaccgaaccggtaacccgggttcccttaacgttaaaccgtttacgtcggtacggacccgaaggaacgggacggaaccggggg

SEQ ID NO: 434052 - DNA, 623 bp, Homo sapiens
  misc_feature: GZ8MTXP02I1XHQ.51.12.B01.1.454.CMB.2.raw
  modified_base (289)..(289): a, c, t, g, unknown or other
  modified_base (301)..(301): a, c, t, g, unknown or other
  modified_base (324)..(324): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagacggcccggggctcgagtgaaggtctctgcaagacctcgnggctacaccttnagtgacaacaacgtccagtggtncgccacggcccctggacgaggcctagagtggagtgggacttgggtttgtcgtaggaacgtaccgtgggtcgacccgtataaagttagtacgacgaacgtagggtagggtttacccccccgggggagtacggggtacgtagttacgagtacgggaacccggggacgaccggtaccgacgtaccgacccaacctaacttactacgtacgaacgtacgaccaggtactacgtacgtacgtttacgacgtaccgaccggtaccgttactaacgttacgtggtcgacgacgaggaacggacggg

SEQ ID NO: 434053 - DNA, 593 bp, Homo sapiens
  misc_feature: GZ8MTXP02JAG80.51.12.B01.1.454.CMB.2.raw
  modified_base (328)..(328): a, c, t, g, unknown or other
  modified_base (400)..(400): a, c, t, g, unknown or other
  modified_base (413)..(413): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcgaggtggtgcagtctgggctgaggtgaagacgcccgggctcgagtgagtctcctgacaagacctcgtgcctacgcctttcagtcggaccaaacacgtccgagtgggtcnccgccgacggcccctggacaggggccttaggagtggatggggtattgggtttagctggagaacgtgggtacnccgataaagttgngacagagggtaggtttcggggacgtagggtcagtcgagtacggggaacccgggtactaccgttccacgtccgaccctaactaaccgttacagtacggactacggacctagtcagtacttagttcgaacgtcgtaccggcttaacgtaagttaccgtggtacgacgtacgaggacgtcggg

SEQ ID NO: 434054 - DNA, 641 bp, Homo sapiens
  misc_feature: GZ8MTXP02JL8WP.51.12.B01.1.454.CMB.2.raw
  modified_base (283)..(283): a, c, t, g, unknown or other
  modified_base (289)..(289): a, c, t, g, unknown or other
  modified_base (292)..(292): a, c, t, g, unknown or other
  modified_base (312)..(312): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcaggtggtgcagtcgtggggctggaggtgaaggacgcccgggctcgagtgagtctctgcagcctngctacnctnagtgcacacgcacgtggtcncgcacggcccctggacaggcctgagtgagtgggattgggttgtcgtgagtacgtggtacgccgactaaagttgtagtaccaacgtagggttaggtttaccgggggctaacggggttctaagtccgtaaggtaccgggaacccggggtactacccgggttcccaacgttcccggacccaaaccgtaaccgttaacgtacgtacgggaaaccttacggaacctacggttcgtaacgaccgttaaacgtttccggaaaccgtaaccggtacccgggtccgttactaacgtttaccctgggtacgaccggaacgtaacgggacggaccggggg

SEQ ID NO: 434055 - DNA, 582 bp, Homo sapiens
  misc_feature: GZ8MTXP02ILTI2.51.12.B01.1.454.CMB.2.raw
  modified_base (283)..(283): a, c, t, g, unknown or other
  modified_base (294)..(294): a, c, t, g, unknown or other
  modified_base (301)..(301): a, c, t, g, unknown or other
  modified_base (305)..(305): a, c, t, g, unknown or other
  modified_base (327)..(327): a, c, t, g, unknown or other
  modified_base (407)..(407): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgcccccgctcctcaccatggactggacctggaggatcctcttcttggtggcagcagccacaagacgccccactcccaggtgcaggtggtgcagtcgtggggctggaggtgaagacggcccggggctcgaggtgaggtctccngacaagcctgngcctacncttnagtgacaacaccgtcagtggcnccgcacggccctggacgaggccttaggagtggagtgggattggttagtctaggagtactggggtcgaccgtataaagttnggacacggtagggtagggtttcggggacgtagggtcagtcgagtacgggacccgggactaccgtccagtcccgaccaactaacttacgagtacggactacgacctagtccagtactagttacgaccgacgaccggttctactaacgttcgtacggtcgacgacgtaggacggcgg

SEQ ID NO: 434056 - DNA, 640 bp, Homo sapiens
  misc_feature: GZ8MTXP02JE5TW.51.12.B01.1.454.CMB.2.raw
  modified_base (265)..(265): a, c, t, g, unknown or other
  modified_base (285)..(285): a, c, t, g, unknown or other
  modified_base (295)..(295): a, c, t, g, unknown or other
  modified_base (320)..(320): a, c, t, g, unknown or other
  modified_base (416)..(416): a, c, t, g, unknown or other
  modified_base (608)..(608): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctccctcaccatggactggacctggaggatcctcttcttggtggcagcagccacaagacgccccactcccaggtgcagggtggtgcagtcgtggggctggaggtgaagacgcccggggcngagtgagtctctgcagcctngctacacttnagtcgacaacaccgtcacgtggtcnccgccgacggcccctaggaaccgagggtccttaggagttcggagttgggattgggtttagcgtaggacgtaacgtgggtacgaccgtataaagttnacggtacaacggtagggttggttacggggacgtacgggttcagtacgaggtacggaacccggggactaccggcccacgttacccggacctaaacgtaaaccgttacgagtacggaacctacggaactacgtacgacgtaacgtacgttaccgaaccggtaccgaaccggttcccgtaattaacgtttaccgnggtaacgacggaacgaacggacgggacccggg

SEQ ID NO: 434057 - DNA, 636 bp, Homo sapiens
  misc_feature: GZ8MTXP02I3NHS.51.12.B01.1.454.CMB.2.raw
  modified_base (433)..(433): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagacggcccggggcctcgagtgaacggtctcctgcaagacctctggctacaccttcagtcggacaacaacgtccacgtgggtacgccgccgacggcccctggaacgaaggggtcccttagaggtaggaggtggggatttgggttagtcgtaggaagtaacgtgggtacgaccgaactaaaagtttnacgaccgtaacgtagggttacgggtttcggggacgtaggggtcagttaccgagtacgggaccgggtacacggtccagtccgacctaacaacgttacgaagtacggactacgacgtagtctacgactacgttaggaaccacgtacccggtaccgttaccgttaacttacgtacggtacggaccgacgtacggaacggaccgggg

SEQ ID NO: 434058 - DNA, 575 bp, Homo sapiens
  misc_feature: GZ8MTXP02F9QN2.51.12.B01.1.454.CMB.2.raw
  modified_base (288)..(288): a, c, t, g, unknown or other
  modified_base (327)..(327): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtgcagcagccacaagagcccactcccaggtgcaggtggtgcagtcgtggggctggaggtgaagacggcccggggctcgagtgaaggtctcctgcaagcctcgnggctacaccttcagtggacaacaaccgtcacgtgggtcnccgccgacggcccctaggacaagggtccttaggacgtggacgtggggattagggtttgctaggaacgtacgtgggtacgccgataaaagttgtacgacaacgtagggtacggtttcggggcgtagggtcatcgagtacgggaccgggacaccggtcagtccgaccaactacttacagtcgactgacagtcagatacgttacgacgtacaccggtcttacgtaatacgtgtacgacacgacgacggcgg

SEQ ID NO: 434059 - DNA, 635 bp, Homo sapiens
  misc_feature: GZ8MTXP02GKZQ6.51.12.B01.1.454.CMB.2.raw
  modified_base (95)..(95): a, c, t, g, unknown or other
  modified_base (279)..(279): a, c, t, g, unknown or other
  modified_base (289)..(289): a, c, t, g, unknown or other
  modified_base (298)..(298): a, c, t, g, unknown or other
  modified_base (317)..(317): a, c, t, g, unknown or other
tcagcgatcgtatacacgaccggtgctcgatttagtagtgtagattccgcgggcacgaccggtgctcgatttgtagtgtagattccgcgggggancatcacccagcaaccacatctgtcctctagacgaaccccctgagacgccccgctcctcaccatggactggacctggaggatcctcttcttggtggcagcagccaacaagacgccccactcccaggtgcgaggtggtgcagtcgtgggctggaggtgaagacggcccgggctcgagtgagtctcngacagcctgngctacactnagtgacaacactcagtggncgccgacgcctaggacgaggtcctgacgtggagtggtattgggtttgcgtaggagtacgtggtacgaccgtataaaagttcgagacgaaaggtagggttaacgggttacgggggacgtaaggggtacagtaccgaaggtaccgggaaccggggacctaccggtccaacgtcccggaacctaacgtaaactacgtacgtacggtaaactacggaaccctagtacgtacggaaacttagttaccggaaccgtaacgacccggttacccgttattaaacgttcgtacggttacggaacgtaaccgagggtacggaccgggg

SEQ ID NO: 434060 - DNA, 645 bp, Homo sapiens
  misc_feature: GZ8MTXP02HZL8T.51.12.B01.1.454.CMB.2.raw
  modified_base (287)..(287): a, c, t, g, unknown or other
  modified_base (300)..(300): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgccccactcccaggtgcaggtggtgcagtcgtgggctggaggtgaagacgcccggggctcagtgaaggtctctgcaacgcctntggctacaccttnagtcgaccaacacgtccagtgggtcgccgccgacggcccctaggacaagggtcccttagagtggagtggggtattgggtttagtccgtaggaagtacgtggggtcgaccggtactaaaagtttacgacgaccgtacgggtacgggttaggggttttccgggggacggttacggggtacctagtacgacgtacggggaacccccggggactaaccggtccacgtacccgactaacctacctaactagtaacggaacttcgaactacgtacgtacgacttacgttacgaccgccgtaacccgggtcttactaacgttactcggtacgacgtacgacggaacggccgg

SEQ ID NO: 434061 - DNA, 785 bp, Homo sapiens
  misc_feature: GZ8MTXP02ICIM6.51.12.B01.1.454.CMB.2.raw
  modified_base (210)..(210): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtgcagcagccacaagacgcccacncccaggtgcaggtggtgcagtcgtggggctggaggtgaagacggcccggggctcgaggttgaacggtctcctgaccgaacgacccgtcgtacggtacctaccctaacccgtttcgaacgggttcgggaaccctaaaacccgtaaaccccggttcccgtaaaaccgggttcggggtcccggtacccggtaccccggaaaccccggggttcccccccggtagggaaacccgggtaaacggggttccccgtttaggggtagggttacgggggtaaggtttacgggggtaacggtttttaggggttttaccggttccgggttaaagggtaaacggttaaaccggtggggttaaccgaccccgtaaaacttaaaagttgtaacggtacaaccgggtagggttaccggggtttacggggacgttagggtactacgtacgaacgtaccggacccggggacctacggtacccacgtccgaccaactactagacgtacgacgtacacgtaagttccagtatacgttagaccgtaccgaccggttcttaccttaagttacgcgtcgaacgacgtaaagacggcgg

SEQ ID NO: 434062 - DNA, 631 bp, Homo sapiens
  misc_feature: GZ8MTXP02JYV1B.51.12.B01.1.454.CMB.2.raw
  modified_base (287)..(287): a, c, t, g, unknown or other
  modified_base (298)..(298): a, c, t, g, unknown or other
  modified_base (550)..(550): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagaggcccggggctcagtgaagtctcctgacaagcctcgngctacaccttnagtgacaacacgtccacgtgggtcgcgccgacggcccctaggacgaagggtccttaggagtggagtggggtattgggtttagtcgtaggagtacgtgggtacgaccgactaaaatttgtacgacgtaacggaggggttacgggtttcgggggactagggggttcaagttcgaagttaccggggaccgggggtaccaccggtccaactccggaccctaaactaacgtttacgagttacggaactcggaacccngtaccgtagacttacgttacggaacgtaccgaccggtaccttactaagttacgtgtacgacgtaacgacggaacggccggg

SEQ ID NO: 434063 - DNA, 634 bp, Homo sapiens
  misc_feature: GZ8MTXP02JF99K.51.12.B01.1.454.CMB.2.raw
  modified_base (287)..(287): a, c, t, g, unknown or other
  modified_base (293)..(293): a, c, t, g, unknown or other
  modified_base (298)..(298): a, c, t, g, unknown or other
  modified_base (319)..(319): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagacgcccactcccgaggtgcgaggtggtgcagtcgtggggctggaggtgaagacgcccggggctcagtgagtctctgcagacctcgngctacnccttnagtgcaacacgcacgtggacncgcacgccctggacaggctgagtgagtgggtattgggtttagctaggagtaacgtgggtacgccgataaaattgtcgacaccgggtaagggggttcgggtacggacggtacgacgtacgtacgtacggacccggggtaaccggaccgtaccgttacgaccggtaccctaaaccgaacctttaactaccgttaggaacgtaccgtaccgacttacgtacgtaccgtagtttacgaccggtaaaccgaccggtaccggtaccttaacgtttaaccggtgtacggaccggaacgacggaacgggtaccggaaccgggg

SEQ ID NO: 434064 - DNA, 761 bp, Homo sapiens
  misc_feature: GZ8MTXP02JITAF.51.12.B01.1.454.CMB.2.raw
  modified_base (292)..(292): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagagcccccgctcctcaccatggactggacctggaggactcctctttcttggtggcagcagccacaagacgccccactcccaggtgcgagggtggtcgcaggtcgtggggctggaggtagaacggaacggccccggggctcgaggtgacggtccnccgtgcaacgtacctcgtcggctaccaccgtttcaggttcggaaccaaaccaaccggttccgacggttcggggtccgccggaccccgtaaccgggcccccgtagggaaacccggtaagggcgtttacggaaggttggaaggttggggttagtttacggggttttgacgtagggaacgttaaacggtcggtacggacccggtaattaaaagtttcgacggacgaaaccggggtaggtttacgggggtttaccggggacggtacgggttacgacttcgggaacggttccgggggaaacccgggggttaaaccacccggttaccgacgttaccccggtaaccctaaaccttaaaccgtaagtaccggttaaagggacctacggtaaccgtacgtacgtacgtaactacggtttacgaaccggtcgtaacccgtcgttactaacgttcgtacgtcgacgtacgaggacggtcg

SEQ ID NO: 434065 - DNA, 717 bp, Homo sapiens
  misc_feature: GZ8MTXP02I25XI.51.12.B01.1.454.CMB.2.raw
  modified_base (307)..(307): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgccccgctcctcaccatggactggacctggagatcctcttcttggtggcagcagccacaagacgccccactcccaggtgcgagggtggtgcagtcgtggggctggaggtagaaggacggcccggggctcgaggtggacggtctctgacaagcctgtgcctactctngtcgacaacgacgtcacgtgggtcgccgccgacggcccctaggacgaagggtcctaggagtgggagtggggtagtttgggtttagtcgtaggaaacggtaacgttcggggtacgaccgtaacgttaaaagtcgtaggaccgtacggggttagggggttccggggtacgggacggttacgtacgtaacgttacgacggggtaaccggggtacccgaaccggttaccggttacaccgggtacctaaaaccgtaacccgttaagtaccgtaacgggaacgttaccggaaacgtaccgtcgttacggaaaccgttaacgtttaccggtaacggaacccgttaccgggtaccccgttacgtttaactccggtttacgacggtaccggaacgtaacggaacgggaccgggaacggg

SEQ ID NO: 434066 - DNA, 673 bp, Homo sapiens
  misc_feature: GZ8MTXP02J0K2B.51.12.B01.1.454.CMB.2.raw
  modified_base (276)..(276): a, c, t, g, unknown or other
  modified_base (295)..(295): a, c, t, g, unknown or other
  modified_base (324)..(324): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcttggtggcagcagccacaagacgcccactcccaggtgcaggtggtgcagtcgtgggctggaggtgaagacgcccggggctcgagtgagtctccngcaagacctgtcggctacnccttcagtcggacaacacgtccagtgggnccgccgacggcccctaggacgaacggggtccttaggacggtggagtggggtacttgggtttacgtcgtagggtaaacgtacgttcgggggtacacccggtataaactttagacggaccgtaacggtaggggtacgggtttcgggggacgtaaggggttcacgtacgtacgtcgggaacccggggtacaccggtaccaccgtaccgaccctaaccgtaacctttaacgacgttacggaacttacgaacccgtaggtccctagaaccgttacgtttaacggaaccggaccgtaacccggtccgtttactaacgtttacctggtacgaccgtaaccgaaggaacggccgggg

SEQ ID NO: 434067 - DNA, 696 bp, Homo sapiens
  misc_feature: GZ8MTXP02FNOJQ.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagacgaaccccctgagacgcccccgctcctcaccatggactggacctggaggatcctcttcttggtggcagcagccacaaagagccccactccccagggtgcgagggttggtgcaggtcgttgggggctggagggtaggaaaggaacggtccccggggcctcgagtggaacggtctctgcaacgcctctggctaccaccttgagtcggacaaacaaccgtccagtgggtcgccgccgacggcccctggaacgagggtcctgaggtggtagtgggtattgggtttatcgtaggaagtacgttgggtgcccgtagtaaaatttgtgacgtaacggagggttagggtttccggggagtacggggtacattacgaggtacgggacccggggtaaccgacccggtacctacgtcccgaaaccgaaccttaaaccttaacgaaggttacggtaaaaccgtacgaacccgtaacgtacgtacgtaaactacgtttaccggaaaccgtaaccggaccggtacccgtttaacgttaacgttaccgttaggacgtaccggaaaggaacgggacggaccggggg

SEQ ID NO: 434068 - DNA, 618 bp, Homo sapiens
  misc_feature: GZ8MTXP02FROV8.51.12.B01.1.454.CMB.2.raw
  modified_base (258)..(258): a, c, t, g, unknown or other
  modified_base (269)..(269): a, c, t, g, unknown or other
  modified_base (276)..(276): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccgggctnagtgagtctcngcaagcncgtgactacacctcagtcggacaacacgtccagtgggtcgcgccgacggcccctggaacaggggccctttaggacgtggagttggggacttgggtttagccgtaggacgtaacgtgggttcgccggtactaaattgtacgacgaacgtagggtacggtttcggggcgtagggtacgatacgtagtcgggaaccgggtacgaacgtccgactacggaccctaacctaacttaacgagtacggtaactacgaccgagtacgtacgaacttcgttacgacgtaaccgtaccggtccgtacgttaacgttaccgtgttacggaccgtaaccgaggaacggtccggg

SEQ ID NO: 434069 - DNA, 613 bp, Homo sapiens
  misc_feature: GZ8MTXP02JUJSR.51.12.B01.1.454.CMB.2.raw
  modified_base (278)..(278): a, c, t, g, unknown or other
  modified_base (296)..(296): a, c, t, g, unknown or other
  modified_base (324)..(324): a, c, t, g, unknown or other
  modified_base (490)..(490): a, c, t, g, unknown or other
  modified_base (589)..(589): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcgttggtggcagcagccacaagacgccccactcccaggtgcaggtggtgcagtcgtgggctggaggtgaaggacgcccggggctcgagtgacgtctcngcaagcctgtcgctaccncttcagtcgacaacaccgtcacgtggcncgccgacggcccgtagacgaggtccgtgagtcggagtggtagttaggtttcgtcgtaggtagtaaccgtgggtcgacccgtataaacgttatcgacgaaggtagggtacggtttcggggactacgggttacagttacgaggtaccgggaccgggaccacgtacacnccggaactactaacgttacgagtacggtactacgacgtagttaccgtagtattaacggttccgaaccgtaccgtaccggtcccttagttaactccggtnaccggcgacgacggaacggccggg

SEQ ID NO: 434070 - DNA, 687 bp, Homo sapiens
  misc_feature: GZ8MTXP02GHBA6.51.12.B01.1.454.CMB.2.raw
  modified_base (218)..(218): a, c, t, g, unknown or other
  modified_base (294)..(294): a, c, t, g, unknown or other
  modified_base (300)..(300): a, c, t, g, unknown or other
  modified_base (305)..(305): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagcccccgctcctcaccatggactggacctggaggatcctcttcttggtgcagcagccacaagacgcccactcccaggtncaggtggtgcagtcgtggggctggaggtgaagaacggccccggggcctgaggtgaacggtcctcgtgccaagcctngctacnccttnagtgaccaacgaccgtcacgtggtcgccgcccgaacgccccaggacgaaggccccttaggagtggacgtgggattcggggtttcgtctaggaacgtacgtgggacgacccgtaactaaaagttgacggctaaacgggagggtaacggtttccggggcgttaaagggtccgaacgtaccgaggttaaccgggaaccggggtaactacccggcgttaacgccggtaaccccaacgttaacttacgacgttacggaaccttagaacccctagtaccgtagtaaccgttaacgtttacggaaccgtacggtaaccccggttcgtaaccgttaacgtttacccgtaggtaccgtacccggaagttaaccggggacggtaacccgggg

SEQ ID NO: 434071 - DNA, 731 bp, Homo sapiens
  misc_feature: GZ8MTXP02G3KNI.51.12.B01.1.454.CMB.2.raw
  modified_base (313)..(313): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagcccccgctcctcaccatggactggacctggaggatcctcttcttggtggcagcagccacaagacgccccactcccagggtcgcgagggtggtgcagtcgtggggctgaggtgaaggaacgcccggggcctgaggtgacggtctcctgcaacgcctcgtggcctaccaccgttnaggtacggacaaaccgaaccggtcccaggttcggggtcgcccggaccccgacggggtccccccgtagggaacccgaaacggggtccctttagggaaggttggggaacgttgggggtaatttccggggtttaggtctaagggtacgtaaaccgttggggttacgacccggtaaataaagttagtacgacgtaacgtaggggtaaggtttccgggggacgtaaagggtccaagtccgtaagtccggggtaaaccccggggactacccgtacgacgttacccggacctaaaccgtaaacttacgaacgttacggggtaactaccggaacgttacggtacgttaccggtatacgtttacggaccgtaacggaccgtcgtactaacgttacggtgtacgacggtacgacggtaacggccgggg

SEQ ID NO: 434072 - DNA, 675 bp, Homo sapiens
  misc_feature: GZ8MTXP02FJD6X.51.12.B01.1.454.CMB.2.raw
  modified_base (301)..(301): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagagcccggggctcgagtgaaggtctcctgacaagacctgtggctacacctttnagtggacaacaacgtccacgtggtcgccgaccgacggccccctggaaccgaaggggtccttacggaggtggagtggggattgggtttagcgtaggtagaacgtggtacgacccgtaataaaattgtagaccaagtagggttaacgggtttcggggaccgtaggggttacagttaccgaaggtcgggaacccgggggaactacccggttaccacgttacccggaacccaaacccgttaaactttacgaagttacggaaaccttcggaaccctacgttacgtcgtaaacgttagtttacgaaccggaccgtaaccggggtcccgtttactaaagtttccgttaggtacggactaaaccgaacggaacgggaccggg

SEQ ID NO: 434073 - DNA, 638 bp, Homo sapiens
  misc_feature: GZ8MTXP02HBQ44.51.12.B01.1.454.CMB.2.raw
  modified_base (178)..(178): a, c, t, g, unknown or other
  modified_base (202)..(202): a, c, t, g, unknown or other
  modified_base (279)..(279): a, c, t, g, unknown or other
  modified_base (287)..(287): a, c, t, g, unknown or other
  modified_base (301)..(301): a, c, t, g, unknown or other
  modified_base (433)..(433): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctnttcttggtggcagcagccacaagngccccaactcccaggtgcaggtgtgcagtctggggctgaggtggaagaggccccggggctcgaggtggaaggtctcngcaagccncgtgctacaccttnagtgacaacaactcacgtggtcgcgtccacggccccgtaggaccaagggtccccgttaggacggtgggtatggggtaccgtttgggtttacgtcgtaggaacgtacgtgggtacgacccgaattaaaagttnagacgaacggtaggtacgggttcgggacgtggtacagtacgtagtaccgggaccggtaactacgtaccacgtaccgaacctaaacgtaacgtacgacgtaacgtagtaccgactcgtactcgtaaacttacgtaccgaacccgtacggacccggtacttacgtaacgttcgtacggccgaacggtaaccaacgggtaaccggcgg

SEQ ID NO: 434074 - DNA, 529 bp, Homo sapiens
  misc_feature: GZ8MTXP02FUJR9.51.12.B01.1.454.CMB.2.raw
  modified_base (277)..(277): a, c, t, g, unknown or other
  modified_base (279)..(279): a, c, t, g, unknown or other
  modified_base (287)..(287): a, c, t, g, unknown or other
  modified_base (293)..(293): a, c, t, g, unknown or other
  modified_base (296)..(296): a, c, t, g, unknown or other
  modified_base (308)..(308): a, c, t, g, unknown or other
  modified_base (316)..(316): a, c, t, g, unknown or other
  modified_base (339)..(339): a, c, t, g, unknown or other
  modified_base (344)..(345): a, c, t, g, unknown or other
  modified_base (348)..(348): a, c, t, g, unknown or other
  modified_base (354)..(355): a, c, t, g, unknown or other
  modified_base (373)..(373): a, c, t, g, unknown or other
  modified_base (440)..(440): a, c, t, g, unknown or other
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagacgccccgctcctcaccatggactggacctggaggatcctcttcgttggtggcagcagccaacaagacgccccacctcccaggtgcagggtgtgcagtcgtggggctggaggtgaagacggcccgggctgagtgagtcncngcagcctngctacnctnagtgacaacacncagtggcncgccgacgcccagacgaggctgngaggnnggnttgttnntgagactgtcacataatngacagaggtagggttcggctaggctgacgagcgggaccggacgaccgtcacgtccgacactaacgtnagtacgactacgacgtgtcgtagacttcgtacgacgtaccgaccgtccgttataacgttacgcgtacgacgaacgaggacggtaccggg

SEQ ID NO: 434075 - DNA, 645 bp, Homo sapiens
  misc_feature: GZ8MTXP02JCTC5.51.12.B01.1.454.CMB.2.raw
tcagcgatcgtatacacgaccggtgctcgatttagtagtgtagattccgcgggcacgaccggtgctcgatttgtagtgtagattccgcgggggagcatcacccagcaaccacatctgtcctctagagaaccccctgagagccccgctcctcaccatggactggacctggaggatcctcttcttggtggcagcagccacaagagccccactcccaggtgcgagggtggtgcaggtcgtggggctggaggtgaaggacggccccggggctacgaggtgaaggtctacctggcaagccctgtggcctaccacttcaggtcggacaaacgaaccgtccaacggtgggtcgccgcccgtacggcccctagggacgtaaggggtccttaggaggtggagtgggtaattgggtttagctaggacgtacgtgggcaccgataaatgtgacgagtaggtgggtttacggggcgtagggtactagtacgtacgtacgggacccgggtacaccggttccacgtacccggacctaacgtaacttaacgagttacggaacgtcgaaccgtagtccgtagtactacgtttacgaaccggtaccgaaccgggttcccgttataacgttacgtcgtacgaccgacgtacggaacggccggg

SEQ ID NO: 434076 - DNA, 619 bp, Homo sapiens
  misc_feature: GZ8MTXP01EL2D7.13.37.D04.1.454.CMB.2.raw
  modified_base (284)..(284): a, c, t, g, unknown or other
  modified_base (291)..(291): a, c, t, g, unknown or other
  modified_base (494)..(494): a, c, t, g, unknown or other
  modified_base (578)..(578): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggagcttggttcagccgtgggggtccctgagactctcgtgtgcagcctcgtggtatttagtttancagttangcatgagcgtgggtcccgccgaggcctccggagggggaacggggcgtaggggtaggtttgggggtttcgggtagtttagtgcttcgtgatgatagacactaatactgtgacgtacgaccgttaccgggttaacgggccgtcttaccaacctatcctaccgaagaacaacctaacttaccaagtaacacgtactaatactcgtnacgaagagtacgaaacgcggtccgaggggaccgccggtaaggacccgtaacggtcgtttattcgacgttggagtaagaaagttnttagttaagtaatcggtaagtcggttagtcgttgttaaccg

SEQ ID NO: 434077 - DNA, 547 bp, Homo sapiens
  misc_feature: GZ8MTXP01BFOP3.13.37.D04.1.454.CMB.2.raw
  modified_base (377)..(377): a, c, t, g, unknown or other
  modified_base (458)..(458): a, c, t, g, unknown or other
  modified_base (491)..(491): a, c, t, g, unknown or other
  modified_base (514)..(514): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagccgtggggggtccctgagactctcgtgtgcagcctctggatttagtttagcagttatgccatgagcgtgggtccgccaggctccgaggggaaggggctgggagtggggtttcggtattagtgctctgatggatagcacaatactntgcagactccggttaagggccgcttcaccatctccagagaacaattccaaagacacgctaatactctgcagatggaaaccncgccgtagggacgccgaggaccgacggtcttancgtacgttgtacgaagaaagttnttagttaagtagtgtagtggttacgtcgttgtc

SEQ ID NO: 434078 - DNA, 661 bp, Homo sapiens
  misc_feature: GZ8MTXP01EUGVL.13.37.D04.1.454.CMB.2.raw
  modified_base (289)..(289): a, c, t, g, unknown or other
  modified_base (297)..(297): a, c, t, g, unknown or other
  modified_base (598)..(598): a, c, t, g, unknown or other
  modified_base (625)..(625): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtgggggagtcgttggttcaggccgtggggggtccctgagactctcgtgtgcagcctcgtggtatttagtttanctagttangccatgagcgtcgggtcccgccgaggcctaccggagggggaacggggcgtggggtaggtttgggggtttacgggttagttaggtcgtcttcgttagtactgtaatacgactaacaaattaactaagtgacgtaacgtaccgttaccgggttaacggggccctcttacccaacctattcccaccgaaggaactaaacctaaacttaccaaaacgaaccaccgtacttaaatactccgtagacaagagtacgaaacgcggccgtagggggaacctcccggaaggaccgccgggttcctttaanccgaagttggacgaacgttaaaagttnttagttaagaatgtaggtcggttatcgttcgtaacc

SEQ ID NO: 434079 - DNA, 640 bp, Homo sapiens
  misc_feature: GZ8MTXP01BQZLG.13.37.D04.1.454.CMB.2.raw
  modified_base (269)..(269): a, c, t, g, unknown or other
  modified_base (291)..(291): a, c, t, g, unknown or other
  modified_base (308)..(308): a, c, t, g, unknown or other
  modified_base (372)..(372): a, c, t, g, unknown or other
  modified_base (379)..(379): a, c, t, g, unknown or other
  modified_base (502)..(502): a, c, t, g, unknown or other
  modified_base (594)..(594): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtgggggagcttggttcagccgtggggggtccctgagctctcgtgtgcagcctntggtatttagtttagcagttangccatgagctgggtccncgaggctccgaggggaagggctgggaggttgggtttcggtattaggtgctcttgatgatagcanaatactntgcagacctccggttaagggcccgtcttccaacctagtccctaccgaagacgtaaacctaaactttccccaaaagaaccacccgtattaaattactccgttagacgaagtaacgtacgaaacncggacccgttagggggactaccccgggaagggtaacccaccggggttaaccgtttttaacacgtaaccgttggtacgaacgttaaaaggttnttaagtttaagtaaatggaacgttgggttaagtcgttaacgtaacc

SEQ ID NO: 434080 - DNA, 567 bp, Homo sapiens
  misc_feature: GZ8MTXP01EFQUX.13.37.D04.1.454.CMB.2.raw
  modified_base (378)..(378): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggaggcttggttcagccgtggggggtccctgagactctcgtgtgcagcctctggtatttagtttagcagttatgcatgagcgtgggtccgcaggctccgaggggagggctgggagttggggtttcggtattagtgtctcttgatgatagcacaatactntgacagactaccgggttaacgggccgtcttacacctatctaccagacgaactaacttaccaaagaaacacatatatctagcagatagaacagccgtagggacgccgagacgcggtaaccgtttattccgattggacgaacgttaaaagattagttaagtaaagtggtaatgggttactcgttaagaacc

SEQ ID NO: 434081 - DNA, 645 bp, Homo sapiens
  misc_feature: GZ8MTXP01EIJD4.13.37.D04.1.454.CMB.2.raw
  modified_base (226)..(226): a, c, t, g, unknown or other
  modified_base (302)..(302): a, c, t, g, unknown or other
  modified_base (316)..(316): a, c, t, g, unknown or other
tcagtcacgtactacacgaccggtgctcgatttagtagcatactgttgggtttgggggtctcaggaggcagcactctcgggacgtctccaccatggcctgggctctgctcctcctcagcctcctcactcagggcacaggatcctgggctcagtctgccctgactcagcctcgctcaggtgtccgggtctcctggacagtcagtcaccatctcctgcactggaaccngcagtgattggttggtagttataactatgtctctgtatcaacaacaccaggacaaacgccccaaatcatcatttanagaagtctatttancggcctcgtaaggtatttacgtaactcgtcttctctggaccttaccaagtctcgggacaaccgaccggtccctcccgtacaccctatctcgtgggcctaccgaggctaggaacgacgaggctagtatttacggttactggactacgtactacactttaactaaaccaaacctaacttaacgaaacctaaccgaaacgtaacggtttaccgttaacgggttaaacggttaacggggaaacccttaaaacggttccgttaacccggttaaccgttaacggtaacccgtaccggaccccgaaacgggaacccccgttaaaccccgttaaccg

SEQ ID NO: 434082 - DNA, 623 bp, Homo sapiens
  misc_feature: GZ8MTXP01BL66L.13.37.D04.1.454.CMB.2.raw
  modified_base (266)..(266): a, c, t, g, unknown or other
  modified_base (477)..(477): a, c, t, g, unknown or other
  modified_base (511)..(511): a, c, t, g, unknown or other
  modified_base (541)..(541): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtcgtgggggagcttggttcagccgtgggggtccctgagactctcgtgtgcagcctntggtatttagtttagcagttatgccatgagcgtgggtccgccaggctccgaggggaagggctgggaggttggggtttcggtattaggtgtctcgttgactggatagcacaatactaatgacagactccggttaagggcctcttcactatcctaccagacgaaacaattacccaaagaaccacgcttaatactctggacaagatacgaaacncggaccttagggggacgacccgggaagggacccncgggggaacccttaggttaactttaaccgngggtacggacggaggaacgttcgggtaaccgggggaccccctaagggtaaaaccgtttaccgaggtccgttaaaggtccggg

SEQ ID NO: 434083 - DNA, 601 bp, Homo sapiens
  misc_feature: GZ8MTXP01BC4MF.13.37.D04.1.454.CMB.2.raw
  modified_base (292)..(292): a, c, t, g, unknown or other
  modified_base (310)..(310): a, c, t, g, unknown or other
  modified_base (386)..(386): a, c, t, g, unknown or other
  modified_base (429)..(429): a, c, t, g, unknown or other
  modified_base (494)..(494): a, c, t, g, unknown or other
  modified_base (507)..(507): a, c, t, g, unknown or other
  modified_base (536)..(536): a, c, t, g, unknown or other
  modified_base (563)..(563): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggaggcttggttcagccgtggggggtccctgagactctcgtgtgcagcctctggtatttagtttagcagttangccatgagctgggtcccncaggcctcgaggggagggctgggtaggtggggtttcggtattaggtcgtctcttgacttggatagcacaattactntgacacgtacttccggttaagggccctacttacccacattccnccgaagaacgaacctaaattacccgaaagaaccacgcttaatacttcgtgactaagatagaaccngccgtaggggacnccggaaggtaccaccgggtcccttttaancgtacgttggaacgaacgttaaagttnttagttaagtaacgtggtaacgtggttactcttcgtcc

SEQ ID NO: 434084 - DNA, 555 bp, Homo sapiens
  misc_feature: GZ8MTXP01AJNC1.13.37.D04.1.454.CMB.2.raw
  modified_base (284)..(284): a, c, t, g, unknown or other
  modified_base (378)..(378): a, c, t, g, unknown or other
  modified_base (452)..(452): a, c, t, g, unknown or other
  modified_base (497)..(497): a, c, t, g, unknown or other
  modified_base (520)..(520): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctggggggaggcttggttcagccgtggggggtccctgagactctcgtgtgcagcctctggtatttagtttancagttatgccatgagctgggtcccgccaggctccgaggggaaggggctgggagtgggtttcggtattagtgctcttgatgatagcacaatactntgcagacctcggttaaggccgcttcaccatctccagagacattaccaaagaacacgactatactcgtgcagacngaacagccgtaggggacgcccggaaggaccgcgggtcccgtttanccgacgttggtagacgaaagttnttattaagtaatggacgttggttatcgttgtaacc

SEQ ID NO: 434085 - DNA, 731 bp, Homo sapiens
  misc_feature: GZ8MTXP01B8BW8.13.37.D04.1.454.CMB.2.raw
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggagcttggttcagccgtgggggtccctgagactctcgtgtgcagcctcgtggtatttagtttagcagttatgccatgagcgtgggtcccgccgagggcctccggaggggaacgggggcgtgggtaggttgggggttttcggtattaggtgtctcgttgactgagtagccacaattactaagtcgacagtacccgtaccggttaacggggccctctttacccgaacctactcccgtaccaggaaacgtaacctaaacttcccgaaaaggaaccctacgtaccttaaattaaccgtttcggtagaccgtaaagggtaaacttacggaaacccgacgggtcccgttaaggggggaacccgtacccgggggaaacgggtacccgtaacccgggggttcccgttttaaattccccgggtaaacgtttggggtaacgaacgggttaaaaagttgtttaaacggtttaaggtaaaagttggtaaacgtgggggttaactcccgtttaagggttaacccc

SEQ ID NO: 434086 - DNA, 689 bp, Homo sapiens
  misc_feature: GZ8MTXP01CHNPT.13.37.D04.1.454.CMB.2.raw
  modified_base (198)..(198): a, c, t, g, unknown or other
  modified_base (311)..(311): a, c, t, g, unknown or other
  modified_base (393)..(393): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcacatggagtttgggctgaactggtctttttctgtggcttatttaagaggtgtccagtgtgaggtncaactgttggagtcgtgggggagcttggttcaggccgtgggggtccctggagactcgtcgtgtgcagcctgtggtatttaggtttagcagttatgccatgagcgtgggtcccncgaggcctccgagggggaaggcgtgggagttgggggtttcggtattagtgtctgttgagttggatagcaactaattactaangactagtacccgtacgggttaacgggccctactttaccaaccacgtttcccgaaccaaagggacaaaaccttaaacttaccgaaaacgaaccacgtactatactccgtaggacctaaagacgtaacggaaacccgcgggtaccggtaaggggaaccgacccgggtaaacggtaaccccgttaccgggtttaacctttaacgcccgtaaggttacggtaaacgtaaacggttaaaagttcgtttaaggttaagtaaagtgggttaaccggttacgggttactccgttaacgttaacc

SEQ ID NO: 434087 - DNA, 731 bp, Homo sapiens
  misc_feature: GZ8MTXP01AZ3RD.13.37.D04.1.454.CMB.2.raw
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttgggagtcgtgggggaggtcgttggttcagccggtgggggtccctgagactctcgtgtgcacgcctcgtggtatttagtttagctagttatgccatgagcgtcgggtcccgccgaggcctccggagggggaacggggcgtgggtaggttggggttttcgggtatttaggtcggtcttcgttgacgtgaagtacgactaactaaattaactgtcgacgtaagtacccgtttacccgggttaaacggggccccgtacttacccaacctaacttccctacccgaaagaacgtaaacctaaacttaccaaaagaaaccacgtacttaattaactcgtagacaagtacgtaagaaccacggtccgtagggggacgtaaccccgggagggtaaacccctaccgggggttaacccttttaagcccgtaacggtttcgggtaaaggaaaccgggttaaaaaagttattttaaacgtttaaggggtaaacttgggtaagttacgggggttaatccgtttaacggttaaaacccc

SEQ ID NO: 434088 - DNA, 706 bp, Homo sapiens
  misc_feature: GZ8MTXP01BJIU2.13.37.D04.1.454.CMB.2.raw
  modified_base (224)..(224): a, c, t, g, unknown or other
  modified_base (247)..(247): a, c, t, g, unknown or other
  modified_base (254)..(254): a, c, t, g, unknown or other
  modified_base (294)..(294): a, c, t, g, unknown or other
tcagtcacgtactacacgaccggtgctcgatttagtagcatactgttgggtttgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccngcagtgatgttggtgttatactntgtctcngtaccaacaacaccagacaaacgccccaaatcatgattangatgtacagtaacgccggtacctcgacgggtccctgactcgtcttctctcgaccctactaagtccgtacgggaccaaaccgtaccgggtcccctacccgtacgtaccctacttccgtaccgttcggggaccttaccccggaaggggtccttaggggaaacgggtacgttacggtacgttacgttaacggttaaacgttttaacgtttacgtcgttccgttacggtaccttaacgttaagttacgtcggtacgacggtaccgtaacggtaaccttaaccgttacgtttaacggtttaacggttaaccggggttaccggggaaccgggggttaaaccgggttacccgtaacggtcccggtaaccggttaccccggttaccggttaaccgggtaacccaacccggggtaaccccg

SEQ ID NO: 434089 - DNA, 609 bp, Homo sapiens
  misc_feature: GZ8MTXP01EZX8I.13.37.D04.1.454.CMB.2.raw
  modified_base (232)..(232): a, c, t, g, unknown or other
  modified_base (315)..(315): a, c, t, g, unknown or other
tcagtcacgtactacacgaccggtgctcgatttagtagcatactgttgggtttgggggaggcttggttcagcctgggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaaggccncttcaccatctccagagacaattccaaagaacacgctatatctgcagatgaacagcctgggagccgaggacacggccgtttancactgtgacgaaagatattagtaatgatggtagctgctactaactactttttgacgtacgtcggggaccacgggtaaccctgggtacctacccgtctcttcacgcctccgaaccgaacgggcccacgtccggtcccttcccccgtgacccacccctcctaccaaacgacgcctaccgtcggtcgggggccaacgcgccggcccgtggggcttcgcccgtggttacgaaacggtaccttacgttccgttacggtaaccgtgtaaccgtggacgggccgggtcgttcgggaaccgg

SEQ ID NO: 434090 - DNA, 957 bp, Homo sapiens
  misc_feature: GZ8MTXP01A9VK6.13.37.D04.1.454.CMB.2.raw
  modified_base (290)..(290): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggcttatttaagaggtgtccagtgtgaggtgcaactgttggagtcgtgggggagcttggtcagccgtgggggtccctgagactctcgtgtgcagtcctgtggtattttagttagcagttancgccatgagtcgtgggtccgccgaggcctaccggagggggaacgggggtctggggtagggttgggggttttacgggtaagtttaggtcgtcgttcgtttaggtacgttaggtacttaacggccctaaacgtaaaacttaacccgttaagttacggaacccgtaaacgggttaacccccgtttacccgggggttttaaaacccggggggtcccccttaacccctttttacccgaaaaccccggttaacctttaccccgttaaacccccggtaaaaggggaaacggtttaaaaccccccttaaaaaacgtttttaaccccccggaaaaaaacgggttaaaacccctaaaccccgggttacccgtttaaaaatttaaacccggttccggttaacggggaacccttaaagggtaaaccgttaaaccgggaaaacccgtcggggtaccccgggttaacggggggaaaccgtaaacccccggggggtaaacgggtaaccccgggtaaccccggggtttcccgtttttaaacggacccggtttaaaccccgggttgggtaaacgggttaaaaccccggttaaaaagggtttactttaacgggttttaaagtaaaacgggtttcgggtaaaggtttaccgggggttactaaccgttttaacgggtaaaacccccg

SEQ ID NO: 434091 - DNA, 593 bp, Homo sapiens
  misc_feature: GZ8MTXP01DGGIK.13.37.D04.1.454.CMB.2.raw
  modified_base (311)..(311): a, c, t, g, unknown or other
  modified_base (376)..(376): a, c, t, g, unknown or other
  modified_base (385)..(385): a, c, t, g, unknown or other
  modified_base (477)..(477): a, c, t, g, unknown or other
  modified_base (549)..(549): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtgggggagcttggttcagccgtggggggtccctgagactctcgtgtgcagcctctggtattttagtttagcagttatgccatgagcgtgggtccncgaggctccgaggggaagggctgggaggttgggttttcgggtattagtgctcttgatgatagcanaatactaangacagactccggtaaggccgtctacacatctaccagacgaaactaacttaccaaagaaccacgactaatactcgtagacaagtatagaaacncggcgtaggggcgaccggaaggacctaccggggtaaccctttaacacgtacgttggtacgaagttaaagttnttaagttaagtaagttcgtaagttacggttactcgttcgtaacc

SEQ ID NO: 434092 - DNA, 747 bp, Homo sapiens
  misc_feature: GZ8MTXP01BKG9H.13.37.D04.1.454.CMB.2.raw
  modified_base (255)..(255): a, c, t, g, unknown or other
tcagtcacgtactacacgaccggtgctcgatttagtagcatactgttgggtttgggggaggcttggttcagcctggggggtccctgagactctcgtgtgcagcctctggattttagttttagcagttatgccatgagctgggtccgccaggctccgaggggaaggggctgggagtgggtttcgggtattagtgctcttgatgatagcacatactatgcagacctccggttaagggcctcttcaccatctccaganacaataccaagaacacgactatatctgacagatagaacagccgtgggacgccggaaggacgacggtcctttatcacgtgtagaacgaaagtattaattagtaaagtgtaagtggtacgtctacgtaccttaaccgttaaacctttaacgttttttcggaaaccttaccgggtaccgggggacccctaacgggggtaaccccgttgggtccctacccgttccttccttcgaccgtccctacccgaacccgaaccgggtcccctacgtccccggttcccttacccccgtcgtaccccctacccctaccccgtacccgaaaccgaccgtcccgtaacccgttccggcgggggacccaccgtaccgggccccggtccccggtcgggtcctccggttcccgtacggttaccgtaaaccgggttaccctttacccgtttccgttaaggttaacccggtacgtaaccggttcgggacggttccgggcgttcgggaaccg

SEQ ID NO: 434093 - DNA, 619 bp, Homo sapiens
  misc_feature: GZ8MTXP01AYD4A.13.37.D04.1.454.CMB.2.raw
  modified_base (226)..(226): a, c, t, g, unknown or other
  modified_base (257)..(257): a, c, t, g, unknown or other
  modified_base (265)..(265): a, c, t, g, unknown or other
  modified_base (287)..(287): a, c, t, g, unknown or other
  modified_base (291)..(291): a, c, t, g, unknown or other
  modified_base (297)..(297): a, c, t, g, unknown or other
  modified_base (425)..(425): a, c, t, g, unknown or other
tcagtcacgtactacacgaccggtgctcgatttagtagcatactgttgggtttgggggtctcaggaggcagcactctcgggacgtctccaccatggcctgggctctgctcctcctcagcctcctcactcagggcacaggatcctgggctcagtctgccctgactcagcctcgctcagtcgtccggtctccgtggacagtcagtcaccatctcctgcactggaaccngcagtgatgttggtagtataactatgtctcngtaccaanacaccagacaacgaccccaaancatntattangatgtcaggtacgccggaccctcgacggggtccctgtacctccggtcttctctcgtaccctaccgaagttccgcggacccaaaccgtcccggtcctacccgtacgaccctgttcctcgtccgggtacnccggacggtcttacgggaggtacttcgggtaacttcgtttaggaacttttacgttacgtcgttcgtagtccctagttagtactcggtcaaacggtcaccggtaactacgttagttcgttaaacgtcggttaccgggacggacggacctaacgggtctaaccggccgtacgttaccggtcgaacccggtaacccg

SEQ ID NO: 434094 - DNA, 721 bp, Homo sapiens
  misc_feature: GZ8MTXP01BPWC3.13.37.D04.1.454.CMB.2.raw
  modified_base (289)..(289): a, c, t, g, unknown or other
  modified_base (315)..(315): a, c, t, g, unknown or other
  modified_base (369)..(369): a, c, t, g, unknown or other
  modified_base (387)..(387): a, c, t, g, unknown or other
  modified_base (581)..(581): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggcttattttaagaggtgtccagtgtgaggtgcaactggttggagtcgtgggggagtcttggttcaggccgtggggggtccctgagactctcgtgtgcagcctgtggtattttagtttancagttatgccatgagcgtgggtcccnccgaggctccgaggggaaggggctgggaggttggggtttcggtattagtgtctntgatgatgcataatactntgacgagtaccgttacccggttaagggcccgtcttaccaccctattccgaccaaggtaacgtaaacctaaactttacccgaaaaggaaacctacgtacttaacgtactcgtacgacaagtatacgaaacgcggtacccggtaggggaccgacccggggtaacggtacccgtaacccgggggttcctttttaaancccgtaaccggttggggtacggaacccggttaagggttaacgggttacggggttccccggggggaaaccccctaaacgggtttaaaaccccgggtttaccgttaccccggggtaacgtttttaaacgggtccccgggggg

SEQ ID NO: 434095 - DNA, 617 bp, Homo sapiens
  misc_feature: GZ8MTXP01C4WZB.13.37.D04.1.454.CMB.2.raw
  modified_base (225)..(225): a, c, t, g, unknown or other
  modified_base (346)..(346): a, c, t, g, unknown or other
tcagtcacgtactacacgaccggtgctcgatttagtagcatactgttgggtttgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcacgtggaaccngcagtgatgtggtcgttataacgtatgtctccaggtaaccaacaacacccaggacaaacgacccccaaaatcatgtaattatagatgtacagtaacgccggaccttacgacggggttcccngtacctctcgtctctcgacctacaacgtcacgaaccacgcccgtacctcctacacctactccgtcgtcggtacctaccgaggtcgtaggaaggtagtacggtagttacgttagttaacgtttaacgttacgtcgtactacgtcgtactagtacgtacgtacgacgacgacgtaacctaacgttacgtacgttacgtacggtacgggttacgggacggaaccgaacgtacgtaaccggtaccgtaccgttacggtaaccgaaccggtaaccg

SEQ ID NO: 434096 - DNA, 801 bp, Homo sapiens
  misc_feature: GZ8MTXP01C2YU2.13.37.D04.1.454.CMB.2.raw
  modified_base (224)..(224): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttggctgaactggtctttttcttgtggcttattttaagaggtgtccagtgtgaggtgcaactgttggagtcgtgggggagnttggtcagccggtgggggtccctgagactctcgtgtgcacgcctgtggtatttagttttagctagttatcgccagttcggacgtccggtaggggtccccaccgacggccgttccggaagggggaacgggggtcgtagggggtaggtttgggggttttacgggtagttttagtcgtcttcgttggacttggattacgactacgtaaaacttacgtaagttgacccgaggtacccgttacccgggtaacggggtccctacctttacccaaccttacgtacccgttaccgaaagggtaacccaaaccttaaaacttaccccgaaaaacgggtaaccctaaaccgtcctttaaaacttccgttaaccggttacggacccgaaagggttacttaaacgggaaaccgacgggttaccccggaaagggggtacccggaaaccgggaacgggacccgttaaacccgggttaaccggtttttaaaccgccggttaaacgttacgggtaaacgtaaacggttaaaagtttgtttaaaggtttaaggtaagtcggtaacggttaggttaccgtcgtttaacgtaaccc

SEQ ID NO: 434097 - DNA, 647 bp, Homo sapiens
  misc_feature: GZ8MTXP01BEDVK.13.37.D04.1.454.CMB.2.raw
  modified_base (220)..(220): a, c, t, g, unknown or other
  modified_base (232)..(232): a, c, t, g, unknown or other
  modified_base (308)..(308): a, c, t, g, unknown or other
  modified_base (428)..(428): a, c, t, g, unknown or other
tcagtcacgtactacacgaccggtgctcgatttagtagcatactgttgggtttgggggtctcaggaggcagcactctcgggacgtctccaccatggcctgggctctgctcctcctcagccctcctcactcagggcacaggatcctgggctcagtctgccctgactcagcctcgctcgagtcgtcccgggtctccgtggacagtcagtccacctatctccngcactggaaccngcagtgatggttgtagtatactatgtctcagtaacaacaacaccaggaccaaacgaccccaaatcatagtattagngtagtatcgaagttaacggccggtacccgttaggaccgggtacctcgtaacgtccgtattccgactccgtaaccctacgtaacggtcgtacggaccaaccgtccgtaccctccgtaaccnccgtacgtccgtacgtcgtaccgtccggacggtcgtaagacggtagtacgtacgtacgttagttacgttacgtcgtcgacgtcgtacgtacgtagtacgtccgtagtacgactaacgtaactaacgttacggtaacgttacggtaccgggacggttacggaaacggacggtaaccgtacggtaaccgtaccgtacggttacgtaaccgaacccggtccg

SEQ ID NO: 434098 - DNA, 594 bp, Homo sapiens
  misc_feature: GZ8MTXP02HSCC3.13.37.D04.1.454.CMB.2.raw
  modified_base (383)..(383): a, c, t, g, unknown or other
  modified_base (428)..(428): a, c, t, g, unknown or other
  modified_base (504)..(504): a, c, t, g, unknown or other
  modified_base (532)..(532): a, c, t, g, unknown or other
  modified_base (568)..(568): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcagccgtgggggtccctgagactctcgtgtgcagcctctggtatttagtttagctagttatgccatgagctgggtccgccaggctccgaggggaagggctgggaggttggggtttcggtagttagtgtctcgtttgatgatagcactatactntgacacgtaccgtaccggttaacgggccctcttaccaccattccnccaaggacgactaaacttaccaaagaaaccacgactaatactctagacaagactagaaacgacgccgtaggggacncccggaagaccgacgggttcctttaacnctacgtggacgaacgtaaagttattagttaagtaancggtagtacggtactacgttacgtac

SEQ ID NO: 434099 - DNA, 555 bp, Homo sapiens
  misc_feature: GZ8MTXP02G769Q.13.37.D04.1.454.CMB.2.raw
  modified_base (381)..(381): a, c, t, g, unknown or other
  modified_base (402)..(402): a, c, t, g, unknown or other
  modified_base (459)..(459): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtcgtgggggaggcttggttcagccgtgggggtccctgagactctcgtgtgcagcctctggtatttagtttagctagttatgccatgagctgggtccgccaggctccgaggggaaggggctgggaggttggggtttcgggtattagtgtctcgttgatgatagcacatactntgcagactccgttaagggccncttcaccatcctcagagacaatccaaagaacacgctatactctgacagatagaaacnggccgtggggacgccggaaggacgaccgggtccgttagtattacgtgtcgacgagagagtcggggacccaacggtaacgttacgacgctagtcggg

SEQ ID NO: 434100 - DNA, 525 bp, Homo sapiens
  misc_feature: GZ8MTXP02FOLDM.13.37.D04.1.454.CMB.2.raw
  modified_base (447)..(447): a, c, t, g, unknown or other
  modified_base (449)..(449): a, c, t, g, unknown or other
tcagtcacgtactacacgaccggtgctcgatttagtagcatactgttgggtttggggaggcttggttcagcctgggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtctcccctggccacccctcacagcncnctcggcgcacgcgccgtcggcgcgcgcgtcgacggacgtacctacttcctagtcgtagcggcgtcgcgacgacgcg

SEQ ID NO: 434101 - DNA, 587 bp, Homo sapiens
  misc_feature: GZ8MTXP02JB7OO.13.37.D04.1.454.CMB.2.raw
  modified_base (225)..(225): a, c, t, g, unknown or other
  modified_base (305)..(305): a, c, t, g, unknown or other
  modified_base (370)..(370): a, c, t, g, unknown or other
  modified_base (403)..(403): a, c, t, g, unknown or other
  modified_base (436)..(436): a, c, t, g, unknown or other
  modified_base (458)..(458): a, c, t, g, unknown or other
tcagtcacgtactacacgaccggtgctcgatttagtagcatactgttgggtttggggtctcaggaggcagcactctcgggacgtctccaccatggcctgggctctgctcctcctcagcctcctcactcagggcacaggatcctgggctcagtctcgccctgactcagcctcgctcagtgtccggtctcctggacagtcagtcaccatcctctgcactaggaaccngcagtgattggttggttagttataactatgtctcgtagtaccaacaaccaccaggacaacgaccccaaatcatgtattangatgtacagtacgccggtccctcgacggtcctgacgtccgcttctctcgaccctacgtacgttcncggaccaaccgccggtccctcccgcgaaccctntcctcggcggcctcccgaggctaggagtatcgngtacgtagtactttacttacgngtcgtctctactaatacgtcggacgacggtcaacgtcctaactaccgttgttaaaccctggttaccgggaacggggtacgaacccgtaagccggtacgtaccccgtacgttacggacgaccgaacccgg

SEQ ID NO: 434102 - DNA, 537 bp, Homo sapiens
  misc_feature: GZ8MTXP02IJLLR.13.37.D04.1.454.CMB.2.raw
  modified_base (355)..(355): a, c, t, g, unknown or other
  modified_base (374)..(374): a, c, t, g, unknown or other
  modified_base (486)..(486): a, c, t, g, unknown or other
  modified_base (489)..(489): a, c, t, g, unknown or other
  modified_base (505)..(505): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtcgtgggggaggcttggttcagcctggggggtccctgagactctcgtgtgcagcctctggattttagttttagcagttatgccatgagctgggtccgccaggctccgagggaagggctgggagttgggtttcggtattagtgctnttgatgatagcacatactntgcagacctccgttaaggggcctcttccacatctccagagacaacttacaaagaaaccacgctaatatctagacagatagaacagcgtgggacgcgaggacacggtcgttanacnctgtacgcgaaaagtntaagttaagtaaatgtatggtagtcgtgtacc

SEQ ID NO: 434103 - DNA, 541 bp, Homo sapiens
  misc_feature: GZ8MTXP02F3ZCE.13.37.D04.1.454.CMB.2.raw
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttctgtggctattttaagaggtgtccagtgtgaggtgcaactgttggagtctgggggaggcttggttcagccgtggggggtccctgagactctcctgtgcagcctctgggttcaccgtcagtcacacctacatgagctgggtccgccaggctccgagggaggggctggagtgcgtcttcttttattatagtagtggtatacatactcgcagctccgtggacgggccgattcacatctcagagacaattccaaagaacacgtctgtttactacaaatcgaaacagccgtgagagccgatagacacggcgtgtatacgtgtgcgagagagtcggggacccacgaacgttaacgacgctacgcggtacgtcgtacggggaccg

SEQ ID NO: 434104 - DNA, 497 bp, Homo sapiens
  misc_feature: GZ8MTXP02FYTPP.13.37.D04.1.454.CMB.2.raw
  modified_base (399)..(399): a, c, t, g, unknown or other
  modified_base (424)..(424): a, c, t, g, unknown or other
  modified_base (440)..(440): a, c, t, g, unknown or other
tcagtcacgtactacacgaccggtgctcgatttagtagcatactgttgggtttgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgtataactatgtctctggtaccaacaacaccaggcaaacgccccaaaatcatgatttatgatgtcagtaagcggccctcgaggggtccctgactcgcttctctgcctcagtctggcacacggcctcctcgaccatcctcgtcgggctcccgaggctgagntgagtctgattattactgctgcctntatagtcgcgagcganctacatcgtactacgtcgacggaggaccaagctacgaccgtcgtacgcgacgacccg

SEQ ID NO: 434105 - DNA, 532 bp, Homo sapiens
  misc_feature: GZ8MTXP02HP8BQ.13.37.D04.1.454.CMB.2.raw
  modified_base (296)..(296): a, c, t, g, unknown or other
  modified_base (373)..(373): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctgggggtccctgagactctcgtgtgcagcctctggattagtttagcagttatgccatgagcnggttttccgccaggctccagggaaggggcgtggagtggggtttcgggtagttagtgctctgatgatagcacatactntgtcagactccgtaagggccgcgttcaccatctccagagacaataccaaacgaacacgactatatctgtcagatagaacagacctgggacgccgaggacgacggccgttatcactgtacgtacgaaagatataagtaatagagtaggtagcgtagtacc

SEQ ID NO: 434106 - DNA, 631 bp, Homo sapiens
  misc_feature: GZ8MTXP02GWW9Z.13.37.D04.1.454.CMB.2.raw
  modified_base (511)..(511): a, c, t, g, unknown or other
  modified_base (561)..(561): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcagccgtggggggtccctgagactctcgtgtgcagcctctggtatttagtttagctagttatgccatgagcgtgggtccgccgaggcctccgaggggaaggggcgtgggagttggggtttcggtattagtgtctcgttgatgatagcacatactatcgacacgtacctaccgggttaacggggcccgtcctttaccaccctacttccctacccgaagaacgtaactaaacttacccaaaagaaccacgacttaaatactcctaggacaagacgtagaaacncgcccggtaggggaacgccggaacgggtaccgaccgggttccgttttaanccgtaaacgtggtacgaacgaaaagtatttaagttaagtaagtggaacgttggggaactcgtacgtaacc

SEQ ID NO: 434107 - DNA, 546 bp, Homo sapiens
  misc_feature: GZ8MTXP02JGX8M.13.37.D04.1.454.CMB.2.raw
  modified_base (297)..(297): a, c, t, g, unknown or other
tcagtcacgtactacacgaccggtgctcgatttagtagcatactgttgggtttgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttatactatgtctctgtaccaacaacaccaggacaaacgccccaaaatcatgattangatgtcagtagcgccctgacgggtcctgactcgtcttctctcgcctcagtctcggccaacaccggccctccctgaccctatcctcgtcgggcctccgagcctaggaggactgacgttctagtaatttacttacctgtcttcgcttacaatcgtgccgtaaggcaagccttacgacttacgtacttaggttccgggacgggtacggaccaaggccgtcggtaccgtacgtacgggtaccacggtaccccg

SEQ ID NO: 434108 - DNA, 548 bp, Homo sapiens
  misc_feature: GZ8MTXP02IOVNV.13.37.D04.1.454.CMB.2.raw
  modified_base (353)..(353): a, c, t, g, unknown or other
  modified_base (372)..(372): a, c, t, g, unknown or other
  modified_base (405)..(405): a, c, t, g, unknown or other
  modified_base (492)..(492): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggcttttcttgtggctatttaagaggtgtccagtgtgaggtgcaactgttggagtcgtgggggagcttggttcagccgtgggggtccctgagactctcgtgtgcagcctctggtatttagtttagctagttatgccatgagctgggtccgcaggctccgaggggaagggctgggagtggggtttcggtattagtgctnttgatgatagcacatactntgcagacctccggttaaggcctcttcacattcnccgagacgacaattcccaaagaaccacgctaatatctgacagatagaacagccgtgggacgccgaaggaccacggggtccttttaancgacgtggacgacgtaaaatattaagtaagtaagtagtagtaggtactactagtac

SEQ ID NO: 434109 - DNA, 541 bp, Homo sapiens
  misc_feature: GZ8MTXP02HJG49.13.37.D04.1.454.CMB.2.raw
  modified_base (305)..(305): a, c, t, g, unknown or other
  modified_base (412)..(412): a, c, t, g, unknown or other
  modified_base (434)..(434): a, c, t, g, unknown or other
  modified_base (444)..(444): a, c, t, g, unknown or other
tcagtcacgtactacacgaccggtgctcgatttagtagcatactgttgggtttgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgattggttggtgttataactatgtctcctgtaccaacaacaccaggacaaacgacccccaaaatcatcgatttangatgtacagtaacgcggccctcgacgggtccctgactcgcttctctgcctcagtctaggccaacgaccggtcctcctcgaccatctcgtcgggctccgagctggagntgagttctagtatttatttacngtctgctacntaatcggacagggcagtctactactacgtacttacgttcggggacggaagggaaccaaggcgtacgtacccggtaccgtacggtccgaacgacccgg

SEQ ID NO: 434110 - DNA, 556 bp, Homo sapiens
  misc_feature: GZ8MTXP02HYCYR.13.37.D04.1.454.CMB.2.raw
  modified_base (312)..(312): a, c, t, g, unknown or other
tcagtcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactcgttaaggccgcttcaccatctccagagacaattccaagaacacgctatatctgcagatgaacagcctgggagccgaggacacggccgtttancactgtgcgaaagatatgtaatgatggtagctgctactactacttttgactacgtggggccagggaaccctggtccaccgtctcttcacgccctccaccgaacgggcccacgtccggtccttcccccgtcggcccaccctccctaccaacgtacgccaccgcgtcgggggcacgacggccgcccgtcgggctcgccgtcggtcgaaacggactactcctagtaacgtgactgagcggctggacg

SEQ ID NO: 434111 - DNA, 604 bp, Homo sapiens
  misc_feature: GZ8MTXP02HB6PH.13.37.D04.1.454.CMB.2.raw
  modified_base (518)..(518): a, c, t, g, unknown or other
  modified_base (550)..(550): a, c, t, g, unknown or other
  modified_base (573)..(573): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcagccgtgggggtccctgagactctcgtgtgcagcctctggtatttagtttagctagttatgccatgagcgtgggtccgccaggcctccgaggggaaggggctgggaggttggggtttcgggtattagtgctcttgatgatgcacatactatgcaacgtaccgttaccggttaaacggggcccgtctttaccaccctaacttcccacccgaagaacgaactaaacttcccgaaaagaacaccgacttaatatcctgacagactagaaaccaggcccgtagggggaacncccgggaaaggaccaccgggtaccgttttacncgaactggtacgaacgaaaagtnttagtaagtaatgatcgggatctacgtaacc

SEQ ID NO: 434112 - DNA, 712 bp, Homo sapiens
  misc_feature: GZ8MTXP02IXMJF.13.37.D04.1.454.CMB.2.raw
  modified_base (294)..(294): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtcgtgggggaggcgttggttcagccggtgggggtccctggagactcgtcgtgtgcagcctctggtatttagtttagctagttangccagtgagcgtcgggtccgccgaggcctccggaaggggaaggggcgtgggtaggttggggtttcgggtattaggtgtctcgttgagtgatagacactattactagtcgactaacggtaccgttacccgggttaaacgggcccggttacctttacccgaaccctactacccgtacccgaaagtaacgtaaacctaactttaacccgaaaacgtaaaacccgacgtacttaaactaacttccgtacgaccgaagtaagttaacgaaaccgtaaccgggtcccggtaggggaccggaccgggaacgggaaccgtacccgggggttacccttttaaagcccgaaccgtttaggaccgtaacggtaaaaacgtatttaagttaagtaacgtaggtacgttacggtacgtcgttaacgtaccg

SEQ ID NO: 434113 - DNA, 573 bp, Homo sapiens
  misc_feature: GZ8MTXP02JMIGJ.13.37.D04.1.454.CMB.2.raw
  modified_base (371)..(371): a, c, t, g, unknown or other
  modified_base (401)..(401): a, c, t, g, unknown or other
  modified_base (414)..(414): a, c, t, g, unknown or other
  modified_base (448)..(448): a, c, t, g, unknown or other
  modified_base (509)..(509): a, c, t, g, unknown or other
  modified_base (533)..(533): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagccgtggggggtccctgagactctcgtgtgcagcctctggatttagtttagcagttatgccatgagctgggtccgccaggctccgaggggaaggggctgggaggttggggtttcggtattagtgctcttgatgatagcanatactatgcagtacctccgttaagggcccncttccaccatccnccagacgaacaacttaccaaagaaccacgctaanactctgcaagatagaacacgccgtaggggacgcccggaaggacgaccgggtccgttttaanctaaccgtggtacgacgaaaagtnttaagttaagtaaacttggaatcggtaagtctaggtaccc

SEQ ID NO: 434114 - DNA, 651 bp, Homo sapiens
  misc_feature: GZ8MTXP02JAB5W.13.37.D04.1.454.CMB.2.raw
tcagtcacgtactacacgaccggtgctcgatttagtagcatactgttgggtttgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttatactatgtctctggtaccaacaacacccaggacaaacgacccccaaaatccatagtattatgatgtcagtaacgccggcctcgacggggtccctgactcgcttctctcgcctcctagtcctaggaccaaccgaccggtccctccctgaccctatcctcgtcggcctcccgagtccgtaggacggtatacgacgttacgtaggttaatttaacttaccgtaggtccttcggtacccttactaatttaggtcgaccgtaagggtcccaaaggtaccctaactaccgttacggttaaaacctacgggtttacccggggaaccgggtaacgggtaaccccgaaaaggggttccctaaccgggttaaccccggtacggtttaaaaccgggtcccgtaaccggtaaacccccgg

SEQ ID NO: 434115 - DNA, 533 bp, Homo sapiens
  misc_feature: GZ8MTXP02FX623.13.37.D04.1.454.CMB.2.raw
  modified_base (305)..(305): a, c, t, g, unknown or other
  modified_base (370)..(370): a, c, t, g, unknown or other
  modified_base (445)..(445): a, c, t, g, unknown or other
  modified_base (481)..(481): a, c, t, g, unknown or other
  modified_base (501)..(501): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtctgggggaggcttggttcaggcctggggggtccctgagactctcgtgtgcagcctctggatttagtttagcagttatgccatgagctgggtccnccaggctccgagggaggggctgggagtgggtttcggtattagtgctctgatgatagcacatactntgcagactccgttaaggccgcttcaccatctcagagacattccaagacacgctaatatctgacagataggaaacncggcgtagggacgaccggagaccgtacggtacttanctacgtggacgacgaaagtnttaagtaagtaatggtacgtgtacgctagtac

SEQ ID NO: 434116 - DNA, 630 bp, Homo sapiens
  misc_feature: GZ8MTXP02G90C9.13.37.D04.1.454.CMB.2.raw
  modified_base (308)..(308): a, c, t, g, unknown or other
  modified_base (376)..(376): a, c, t, g, unknown or other
  modified_base (476)..(476): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtcgtgggggaggcttggttcagccgtggggggtccctgagactctcgtgtgcagcctctggtatttagtttagctagttatgccatgagctgggtccncaggctccgaggggaaggggctgggaggttggggtttcgggtattaggtgtctcgttgatgatagcanatactatgacagccgtaccggttaacgggcctcttcaccattcaccgagacgactaacttccaaagaaccacgcttaaatcgtactgacaagtacgtaanaaacgtacgcccggtagggggaacgccccggaaaggggacccacccgggggttacctttaaacgcgtaacccggttaggtacggaaccgaaaaaggtttagtttaaagttaagttaacgtaggtaacgttagggtacgtccgtttaacggtacc

SEQ ID NO: 434117 - DNA, 571 bp, Homo sapiens
  misc_feature: GZ8MTXP02JMRIN.13.37.D04.1.454.CMB.2.raw
  modified_base (313)..(313): a, c, t, g, unknown or other
  modified_base (390)..(390): a, c, t, g, unknown or other
  modified_base (457)..(457): a, c, t, g, unknown or other
  modified_base (475)..(475): a, c, t, g, unknown or other
  modified_base (508)..(508): a, c, t, g, unknown or other
  modified_base (531)..(531): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggaggcttggttcaggccgtggggggtccctggagactctcgtgtgcagcctctggtatttagttttagctagttatgccatgagctgggtccnccaggcctccgaggggaaggggctgggaggttggggtttcgggtatttaggtgtctcgttgatgatagcacatactntcgcagacctccggttaagggcccgtcttcactatctccagagacaattccaaagaacacgctaatntcgtgcaagatagaaacngccgtgggacgccggagaccacggtccgtttanccaacgtggtacgacgaaaagtnttaagttaagtaaatcggagtaggtacgcttaggtaaccc

SEQ ID NO: 434118 - DNA, 566 bp, Homo sapiens
  misc_feature: GZ8MTXP02IEYCZ.13.37.D04.1.454.CMB.2.raw
  modified_base (284)..(284): a, c, t, g, unknown or other
  modified_base (361)..(361): a, c, t, g, unknown or other
  modified_base (428)..(428): a, c, t, g, unknown or other
  modified_base (457)..(458): a, c, t, g, unknown or other
  modified_base (463)..(463): a, c, t, g, unknown or other
  modified_base (465)..(465): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggagcttggttcagccgtgggggtccctgagactctcgtgtgcagcctctggtattttagtttanctagttatgccatgagctgggtcccgaccagggctccgaggggaagggctgggagttgggtttcgggtattgtgctnttgatgatagcatatactagtgcaacgtactcccgggttaagggccctcttcaccatcctaccaganacaattcccaaagaacacgctagtactcnncgaananagacacgcgcggacgacgacggacgacggtacgttacgtactactagtacgacgaaacgtaagtagttaagtaagtagtagtaggtacgtacgtacgtacg

SEQ ID NO: 434119 - DNA, 676 bp, Homo sapiens
  misc_feature: GZ8MTXP02H7Q72.13.37.D04.1.454.CMB.2.raw
  modified_base (310)..(310): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactggttggagtcgtgggggaggcttggttcagccgtgggggtccctgagctctcgtgtgcagcctgtggtatttagtttagctagttatgccatgagcgtcgggtccnccgaggcctcgaggggaggggcgtagggtaggttggggtttcggtattagtgtctgttgatgatagcactatactgtcgacacgtaccgttaccggttaagggccctacgttaccacacgtcctaccgaaggaacgtaactaacttaacccgaaacgtaaaccgacgtacttaactaacgttccgtaggtaccaagggtatacgaaaaccgacggaccggtacgggggaacggcccgggaagggaaacccgtaccggggtaccggtttttaacacgtacgtacggttacggaacggtaaaaagtagtttaagttaaagggttaaagttacggtaacgttaggggtacctacgtttacgttaacccg

SEQ ID NO: 434120 - DNA, 562 bp, Homo sapiens
  misc_feature: GZ8MTXP02FV1CC.13.37.D04.1.454.CMB.2.raw
  modified_base (451)..(451): a, c, t, g, unknown or other
  modified_base (470)..(470): a, c, t, g, unknown or other
  modified_base (502)..(502): a, c, t, g, unknown or other
  modified_base (524)..(524): a, c, t, g, unknown or other
  modified_base (553)..(553): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtcttttcttgtggctattttaagaggtgtccagtgtgaggtgcaactgttggagtcgtgggggaggcttggttcagccgtggggggtccctgagactctcgtgtgcagcctcgtggtatttagtttagcagttatgccatgagctggtccgcaggctccgagggaggctggagtgggttcggtagttagtgctcgtgatgatagacacatactatgcagaccttccgggttaacggcccgtcttacacccattcctaccgagacgaacaattacccaaagaacacgctaatacnctagcagtatacgaaaccncgcgaggacgcggaagaccgtacggtacttanacgtacgtgacgaacgtaaatnttaagttaagtaagtagtacgtaggtacncgtacgtac

SEQ ID NO: 434121 - DNA, 723 bp, Homo sapiens
  misc_feature: GZ8MTXP02JCIEP.13.37.D04.1.454.CMB.2.raw
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcagccgtgggggtccctgagactctcgtgtgcagcctctggtattttagtttagctagttatgccatgagtcgtgggtcccgcgaggcctccgaggggacggggctagggaggtttggggtttcgggtatttaggtgtcttcgttgacttgatagccactatactatcgacacgtaccgttaccggttaacggggcccgtactttacccaacctacttcccacccgaggaaacctacctaaaacttaccccgaaaaggaacccaacggtaccttaaagttaactccgttaggacccaaaggtaaccgttaacgaaaacccgtacgggacccccggttagggggaaacgacccccggttaaagggggaccaaccccggggggtccttaagggtttaaaccttgggtacgttagggacgaaggtaccggaaggttccgggggaacccccctaaaaggtacccgttaacctaacggtccgttaaaaggtccggggg

SEQ ID NO: 434122 - DNA, 593 bp, Homo sapiens
  misc_feature: GZ8MTXP02GAL6U.13.37.D04.1.454.CMB.2.raw
  modified_base (544)..(544): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggctattttaagaggtgtccagtgtgagtgcaactgttggagtcgtgggggaggcttggttcagccgtggggggtcccccgagactctcgtgtgcagcctctggtattttagtttagctagttatgccatgagcgtggtcccgccaggcctccgaggggaaggggcgtggtggttgggtttcgggtatttaggtgtctcgttgtatcgatagcaactatactatgacacgtaccgtaccgggtaacgggcccgtctaccacccattccctacgaagagaactaaacgtacccaaaacgaaacaccgactaattaactccgtagactaagactaaggaacacgtccgagggacgacgagaccgacggtacctttancacgtgagacgaaagtatagttagtaagcgtataggatctgtacttaac

SEQ ID NO: 434123 - DNA, 549 bp, Homo sapiens
  misc_feature: GZ8MTXP02GFXW2.13.37.D04.1.454.CMB.2.raw
  modified_base (368)..(368): a, c, t, g, unknown or other
  modified_base (373)..(373): a, c, t, g, unknown or other
  modified_base (391)..(391): a, c, t, g, unknown or other
  modified_base (468)..(468): a, c, t, g, unknown or other
  modified_base (492)..(492): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctatttaagaggtgtccagtgtgaggtgcaactgttggagtcgtgggggaggcttggttcaggccgtggggggtccctgagactctcgtgtgcagcctctggtatttagtttagctagttatgccatgagctggtccgcaggctccgaggggaggggctgggagtggggtttcggtattgtgctcgtgatgatagcanatatntgcagacctcgtaggccncttcacatctaccagacgaactacttccaaagtacacgactatactctggacagatacgaaccagcccgtggggacnccggagtaccgacggtccgtttancgtacgtcgacgacgtaaagtatagttaagtaagtacgtagtaggtactctacgtac

SEQ ID NO: 434124 - DNA, 654 bp, Homo sapiens
  misc_feature: GZ8MTXP02GBXH6.13.37.D04.1.454.CMB.2.raw
  modified_base (310)..(310): a, c, t, g, unknown or other
  modified_base (377)..(377): a, c, t, g, unknown or other
  modified_base (467)..(467): a, c, t, g, unknown or other
tcagtcacgtactacacgaccggtgctcgatttagtagcatactgttgggtttggggtctgagagaggagcccagccctgggattttcaggtgttttcatttggtgatcaggactgaacagagagaactcaccatggagtttgggctgaactggcttttcttgtggcttattttaagaggtgtccagtgtgaggtgcaactgttggagtcgtgggggaggcttggttcaggccgtggggggtccctggagactctcgtgtgcagcctctggtatttagttttagctagttatgccatgagcgtgggtccncaggctccgaggggaacggggcgtaggaggttcgggtttacggtattaggtgtcctgtgatgagtancgacatacgtatcgctaagtacctaccgggtaagggcccgtacttccaaccctactcctacccgaaggaacaactaaattacccgaaaanaaaccactaactatacttacgtacgacaagtacgtacgaaaaccgcggtacccggaggggaccgaccggtaacggacccggtaacccggttaccggttacgtaacgtacctaggtacgaaacgtaaacgtaaagtacgttaagtaagtaagtagtaacgttacggtacgtacgtacgttacttaacg

SEQ ID NO: 434125 - DNA, 593 bp, Homo sapiens
  misc_feature: GZ8MTXP02GJZO6.13.37.D04.1.454.CMB.2.raw
  modified_base (293)..(293): a, c, t, g, unknown or other
  modified_base (310)..(310): a, c, t, g, unknown or other
  modified_base (380)..(380): a, c, t, g, unknown or other
  modified_base (490)..(490): a, c, t, g, unknown or other
  modified_base (526)..(526): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggaggcttggttcagccgtgggggtccctgagactctcgtgtgcagcctcgtggtatttagtttagctagttangccatgagctgggtccncaggctccggaggggaggggctgggagttggggtttcggtattagtgctgtgatgatagcaactattacntcgacacgtacctaccggttaacgggccctacttacaccgattccaccgagagaactacttaccgaaaacgtacacgtactaacgtatcgtagactaagatagaaaccgnggaccgagggacgacggacgaccgtacggttcttanaccgtacgtagtacggaaacgtaaagtattagtaagtaagtacgtagttaggtacgcgttacgtacc

SEQ ID NO: 434126 - DNA, 667 bp, Homo sapiens
  misc_feature: GZ8MTXP02H6YJW.13.37.D04.1.454.CMB.2.raw
  modified_base (266)..(266): a, c, t, g, unknown or other
  modified_base (539)..(539): a, c, t, g, unknown or other
  modified_base (589)..(589): a, c, t, g, unknown or other
tcagtcacgtactacacgaccggtgctcgatttagtagcatactgttgggtttggggagctctgagagaggagccccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtgggggaggcttggttcagccgtggggggtccctgagctctcgtgtgcngcctctggtatttagtttagctagttatgccatgagcgtcgggtccgccgaggcctccggaaggggaacggggcgtaggggtacgggtttgggggttttcgggttagttaggtcgtcttcgttgagtgattacgcaactaattactagtcgactaacggtaccgttaccggttaacgggccctcttacccaccactccctacccgaagacgtaaacctaacttacccaaaagaacccacgtacttaatacttccgtagacaggatagaaaccnggccgtagggggaacgcccggtaaggaccccgtaccgggtacttttaacncccgtaacgttggacgtaaacgaaagttagttaactttggtaaacgtgtaaaggtttcggtaacgtcgttacgtaacc

SEQ ID NO: 434127 - DNA, 675 bp, Homo sapiens
  misc_feature: GZ8MTXP02HW43Z.13.37.D04.1.454.CMB.2.raw
  modified_base (415)..(415): a, c, t, g, unknown or other
  modified_base (537)..(537): a, c, t, g, unknown or other
  modified_base (591)..(591): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtgggggagtcttggttcaggccgtgggggtccctgagctctcgtgtgcagcctcgtggtattttagtttagctagttatgccatggacgcgtgggtcccgccgaggcctccggaaggggaacggggcgtggggaggtttggggtttacggggttagtttaggtgtccttcgttgagtgtagtagactactaattacttntcgacagtacccgttaccggttaacgggccctcttacccaactactccctacaagacgtaaactaaaccttaccaaaagaaccacgacttaagttactcgtacgacgagtaatacggaaacncggaccggtgggggaacgtaccggaacggtaccgtaccgggttaccgtttaacnccgtaaacgttcgaacggtaacggtaaaactagttaagtttaaggtaaagttaggacggttaggtaactccgtttacgtaaccc

SEQ ID NO: 434128 - DNA, 641 bp, Homo sapiens
  misc_feature: GZ8MTXP02J2G6V.13.37.D04.1.454.CMB.2.raw
  modified_base (230)..(230): a, c, t, g, unknown or other
  modified_base (313)..(313): a, c, t, g, unknown or other
tcagtcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgtaaggccncttcaccatctccagagacaattccaagaacacgctatatctgcagatgaacagccgtgggagcgaggacacggtccgtttancactgtgacgaaagatattagtaatgagtggtagctgcttactacttactttttgactacgtcggggaccacgggaacctggtcaccgttctcttccacgccctcccgacgacggcccctacgtcccgtcccttcccccgtggccctacccctccctaccaagacgaccacctcggcggggacacgacggtccggccccgtggggccctacggtcccgtacgggttaaccgaaacgggtaccccttaaccgtttacccccgttaaagggttaacccggtcggtaacccggttggtaacggggacccggggttaccgggtacggaacgg

SEQ ID NO: 434129 - DNA, 599 bp, Homo sapiens
  misc_feature: GZ8MTXP02IY6WA.13.37.D04.1.454.CMB.2.raw
  modified_base (542)..(542): a, c, t, g, unknown or other
  modified_base (564)..(564): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggagcttggttcagccgttggggggtccctggagactctcgtgtgcagcctgtggtatttagtttagctagttatgccatgagcgtcggtccgccaggcctccggaaggggaaggggtctgggtaggttggggtttacggtattagtgtctgttgagtgatagcaacatactatcgacaacgtacctaccgggttaagggccctcttaccaaccctatcctccaagtagaaacttaacgtaccaaagaacacgtactaagtactccgtagacaatagacgaaacgcgtccgaggggacgaccggagacgtacgtaccgtttancgagtacgacgaacgaaagttnttagtaagtaaagtgtacgtagtactacgtactac

SEQ ID NO: 434130 - DNA, 722 bp, Homo sapiens
  misc_feature: GZ8MTXP02JX5UM.13.37.D04.1.454.CMB.2.raw
  modified_base (292)..(292): a, c, t, g, unknown or other
  modified_base (309)..(309): a, c, t, g, unknown or other
  modified_base (570)..(570): a, c, t, g, unknown or other
  modified_base (622)..(622): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggagcttggttcagccgtgggggtccctgagactctcgtgtgcagtcctcgtggtatttagtttagctagttangccatgagctgggtccnccgaggctaccggaggggaaggggctaggggaggttcggggtttacggtattaggtcgtctcgttagacgtagatacgacaactagttactagtcgaacgtacgtaacccgttaccgggttaaacggggcccttacttaacccgaaccttactccgttaacccgaaggaaccctaacgtaaacttacccgaaaagtaccactaccttaatacttccgagacgaagtacggtaacaaaccgtacggccggttacgggggaanacccccgggtaaaggggaccccctaaccgggggtttaccccgttttaaaacncccggtaaacgttagggtaaacgaaaaccggttaaaagttacgtttaaggttaacgtaaaggttccggtaaggttacggtacttcggttaacgtaacccg

SEQ ID NO: 434131 - DNA, 752 bp, Homo sapiens
  misc_feature: GZ8MTXP02HOUXR.13.37.D04.1.454.CMB.2.raw
  modified_base (722)..(722): a, c, t, g, unknown or other
  modified_base (738)..(738): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtcttttcttgtggcttattttaagaggtgtccagtgtgaggtgcaactgttggagtcgtgggggagtcttggttcgaggtccggtcggggggtccctggagactctcgtgtgcacgcctcgtggtagttttagtttagcgtagttagcgacctagtgacggtcgtcggggtcccgccgacgggtccgtacggaacgggggtaacggggtcgtaggggtaggtttcgggggtttttacgggttagttaggtcggtcgttcgtttagacgtaggtaactacggacctaacgtaacttaactagttacgacgtaacgtacccgtttaccggggttaaaccggggtcccgttacccttacgaaaccctacttccgtacccgaaagtaaacgtaacccttaaaccgttaaccaaaacgtaacccgacgtaacttaaagttctcgtagacgtaaagacgaacgtaaaacgccggtacggtagggggaccgacggaaacggtacccgtacccggttcgtttaaactcccgtagtacggttaacaaacggtaaaatgtttaacgtaaggtaanacgttaggtaggtacncgtttaagtacccg

SEQ ID NO: 434132 - DNA, 858 bp, Homo sapiens
  misc_feature: GZ8MTXP02FJ982.13.37.D04.1.454.CMB.2.raw
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtgggggaggtcgttggttcaggccggtcgggggtccctggagtactcgtcgtgtgcacgtcctcgtggtattttagtttacgcgtagttatcgcctatgacgcgtcgggtcccgaccgacgggccgtacggaaggggaacggggtcgtaggggtacggtttgggggtttacggttagtttaggtcgtacgttcgtttagacgttagtaatacgtacctaacgtaattaaccgttagtacggacgtaaaccgggttaaaccccggtttacccggggttaaaccgggggtcccccttacccgtttaaccccgtaacccttaacccgttacccgttaacccggaaacggtaaaccgtaaaaccttaaaacccgttaaacccgaaaaaccggtaaaacccgtaaaccgtaaccttaaactttaaccttacgttacgtacgaaacggtaaacgtaaccgtaaaccggtaaccggttacccgggtaccgggggaaccggaaccggggtaaccgggtaacccggtacccgggttaaccgtttaccgtaccgtacggttacggtaacggtaaaccggtaaaagttaacccgtttaagttaacggttaaagttacggtaggttacggtacgtacgtttacggttaaacccg

SEQ ID NO: 434133 - DNA, 540 bp, Homo sapiens
  misc_feature: GZ8MTXP02GSC5I.13.37.D04.1.454.CMB.2.raw
  modified_base (269)..(269): a, c, t, g, unknown or other
  modified_base (339)..(339): a, c, t, g, unknown or other
  modified_base (386)..(386): a, c, t, g, unknown or other
  modified_base (418)..(418): a, c, t, g, unknown or other
  modified_base (434)..(434): a, c, t, g, unknown or other
  modified_base (440)..(440): a, c, t, g, unknown or other
  modified_base (443)..(443): a, c, t, g, unknown or other
  modified_base (459)..(459): a, c, t, g, unknown or other
  modified_base (490)..(490): a, c, t, g, unknown or other
  modified_base (508)..(508): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcagccgtgggggtccctgagactctcgtgtgcagcctcnggtatttagttttagcagtttatgccagtgagcgtcggtccgccaggctaccgagggaaggggcgtaggnggtggggtttcggtagttagtgctcgttgatgagtagacacatactntgcagactccgtaaggccgcttacaccatccncagagacactccaaanacacgntantctgcagatacgaacngccgtaggacgaccgagacgacgtccgttancgactcggagacgaaagnttaagttgaaagtcgaagtgacgcgtactacc

SEQ ID NO: 434134 - DNA, 748 bp, Homo sapiens
  misc_feature: GZ8MTXP02GO924.13.37.D04.1.454.CMB.2.raw
  modified_base (268)..(268): a, c, t, g, unknown or other
  modified_base (328)..(328): a, c, t, g, unknown or other
tcagtcacgtactacacgaccggtgctcgatttagtagcatactgttgggtttgggggaggcttggttcagcctggggggtccctgagactctcgtgtgcagcctctggattttagttttagcagttatgccatgagctgggtccgccaggctccgaggggaaggggctggagtgggtttcgggtattagtgctcttgatgatagcacatactatgcagactccggttaacggcctcttcacatctaccagacgacaattaccgaaanaacacgctatatctgacagatagaacagcgtagggagccggagaccgtacggtccgttancagtcgtagacgaaagtattaagttagtaagtgtagttacggtagctagacttaacttacgttactttttcgaacttacgggtaccggggaccgaacggggtaccccgtcgggtccctaacccgttcttccgttaccgacgtccctacccgaacccgaaccggcccctacgttcccggttccccttacccccgccggtaccccctaccccttaccgacccgtaaacgaccgtacccgtaacccgttccggggacggggacccacggaccgggtccccgggtcccggtacgggtccgtaccggtcccgggtttaccgggaaaccgtaaaccgggtacccgtttaacccgttacccggttaaaacggttcggtaccgtaccggttacgggaaccgggcgggttcccggtaggggaaacccgg

SEQ ID NO: 434135 - DNA, 655 bp, Homo sapiens
  misc_feature: GZ8MTXP02JZ7CQ.13.37.D04.1.454.CMB.2.raw
  modified_base (284)..(284): a, c, t, g, unknown or other
  modified_base (316)..(316): a, c, t, g, unknown or other
  modified_base (462)..(462): a, c, t, g, unknown or other
  modified_base (533)..(533): a, c, t, g, unknown or other
  modified_base (582)..(582): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggaggcttggttcagccgtgggggtccctgagactctcgtgtgcagcctctggtatttagtttanctagttatcgccagtgacgtcgtcgggtcccnccgaggcctaccggaaggggaacggggcgtggggtaggtttggggtttacgggtatttaggtcgtcttcgttggatagtatacgacaactaattactgtcgacacgtaccgttaccggttaaacggggccctacttacccaacctnttcctaccgaaggacactaaacttacccaaagaactcgtacttaaatacgttcagacagagtacgaaaccncggaccggtagggggaccaccggaggtaaccgtaccgggttcctttaancccgtaacgttgaggaaaacgtaaagtacttagttaacgtaattaggaccgttgggtactccgttagtaaccc

SEQ ID NO: 434136 - DNA, 638 bp, Homo sapiens
  misc_feature: GZ8MTXP02FJOZ3.13.37.D04.1.454.CMB.2.raw
  modified_base (215)..(215): a, c, t, g, unknown or other
  modified_base (264)..(264): a, c, t, g, unknown or other
  modified_base (307)..(307): a, c, t, g, unknown or other
  modified_base (328)..(328): a, c, t, g, unknown or other
  modified_base (423)..(423): a, c, t, g, unknown or other
  modified_base (470)..(470): a, c, t, g, unknown or other
tcagtcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgngggggagcttggttcagccgtggggggtccctgagactctcgtgtgcanctctggtatttagtttagctagttatgcatgagtctgggtccncgaggcctcggaggggagggntggtaggttgggttcggtattggtgcttcttgatgtatagcacattacgtagcagtacgtaccgtacggttaacgggcccgttcttaccaacctnttacctaccgaggtacaaactacttaccgaaaacgacacgctatacncgtgacatatacgaaacgtcgacggtggacgacccgaggtaccaacccggggttctttaagaccgtaacgttcgggaaagtaccggaaaaaaggttcctttaaaagttaaccggggtaaaatttaaccgggtagttacgggggtaaacgttcttaaaccggttaaccc

SEQ ID NO: 434137 - DNA, 616 bp, Homo sapiens
  misc_feature: GZ8MTXP01DPJIZ.8.16.B05.1.454.CMB.2.raw
  modified_base (143)..(143): a, c, t, g, unknown or other
  modified_base (263)..(263): a, c, t, g, unknown or other
  modified_base (270)..(270): a, c, t, g, unknown or other
tcagctcgcgtgtccacgaccggtgctcgatttagagctcacgtatttgggtttgggggaggaactgctcagttaggacccagacggaaccatggaagccccagcgcagcttctcttcctcctgctactctggcctccagagntcattggagaagtggtgatgacacagtctccggtcaccctgtcttgtttttccgtggggagagacgcccaccctctcctgtgccggccagtcagagcgttaggacgaacttagctggtancagcagngcctggccaggctccagactcctcatctttggcgtacctttaacgcgggccagtggaactccccgaagccaggttcaggcgcgtaggtcgggtctggggtactacgtctacctctacaccaactctaaactaacctgtactaactactacgtacgtactttcgtctttagtttatttctgtacagctagtctagggagtacgtcggtaccgttcgtaccggttcggtacgggacgggacgtaacgggtacgtaccgtacgaaacggtacgttaggtcggcttacggtaccaaccgttcgttcttcgttaccttccgtcttcccgttacccgtaacccgttgttccg

SEQ ID NO: 434138 - DNA, 607 bp, Homo sapiens
  misc_feature: GZ8MTXP01EMGEK.8.16.B05.1.454.CMB.2.raw
  modified_base (197)..(197): a, c, t, g, unknown or other
  modified_base (204)..(204): a, c, t, g, unknown or other
  modified_base (572)..(572): a, c, t, g, unknown or other
tcagctcgcgtgtccacgaccggtgctcgatttagagctcacgtatttgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggganagagccaccctctcctgtgcggccagtcagagcgttaggacgaacttagcctggtatcagcagaggcctggccaggcctccagcctcctcattctttggccgtacctttaacgacggggccagtacggaactccccaagccgaggttcaggcggcgaggtgggtactggggtacctttcggttacacttctacaccatcaaactaacctgtactaatcgtagacgtactttgcttaacgtttatttctgtcagtctagtctagggaacgtacgttggtaccgttgtaccgtttcggggacgggtaacgggtaccgaaggggtcgtaacccgtacgaaacggtaacttggtcggttctggacaccgttnttctcgttcttctacttccttcccgtcttaactcg

SEQ ID NO: 434139 - DNA, 573 bp, Homo sapiens
  misc_feature: GZ8MTXP01D47XM.39.9.A09.1.454.CMB.2.raw
  modified_base (338)..(338): a, c, t, g, unknown or other
tcagtcgcactagtcacgaccggtgctcgatttagcgagacgcgcagggggagagaggagcccagccctgggatttcaggtgttttcatttggtgatcaggactgaacagagagatctcaccatggaatttgggctgagctggcttttcttgtggctattttaaaggtgtccagtgtgaagtgcagttgttggattcgtgggggaggcttggtacaggccggggggtcctgagactctcctgtgcagcttcaggattcagtcttagcagctacgccatgagctgggtccgccaggcctccgaggggaagggactgggagtgggtctcgaggtattggngcaggtggtgagaccagatactaacgcaagactcccggtggaaacggggtcccggttacacctatcctccagagacaaattacccaaagaaccaccctgtacctctagaccaaatcggaaacaaccgtgaaggacgccgaggaccacggccctatacttactgtaacgaaaagttggaccttacggataagttgacttactaagttgggaacttggtacttcgtaacttcgtcgg

SEQ ID NO: 434140 - DNA, 728 bp, Homo sapiens
  misc_feature: GZ8MTXP01ADZH0.39.9.A09.1.454.CMB.2.raw
tcagtcgcactagtcacgaccggtgctcgatttagcgagacgcgcagggggagagaggagcccagccctgggattttcaggtgttttcatttggtgatcaggactgaacagagagatctcaccatggaatttgggctgagcgtggtcttttctgtggctattttaaaaggtgtccagtgtgaagtgcagttgttggattcgtgggggagcttggtacgaggccggggggtcctgagactctcctgtgcagcttcgaggtattcagtcttagcagctacgcatgagcgtggtccgcgaggcctcgagggaggactgggagtggggtctcgtaggttagttgggtggcgtaggttgggtagaacggaaccaacgtaactaaccgtaaaccgctaacggtacccgtcccgggtagggaaaccggggtcccggttacaacccgtatacccgtaccgaagaacgaactaaacttacccgaaaacgtaaccctaccccttaggtccttaccgtaagaacctaaaagttacgggaaaacctaaacccgtggaaacggaacggacccggtaacggaaacccgtaacccgggtacccttaaagttaaccgttaaacccgtaggtaaaaccgaaaacgttcgggaaaccccgttaagggtattaaacgttcgttaacttaaccgttaaggttacggggtaacttacgggttaaccttcggtaacttcggttcccgggg

SEQ ID NO: 434141 - DNA, 720 bp, Homo sapiens
  misc_feature: GZ8MTXP01C6Y4P.39.9.A09.1.454.CMB.2.raw
  modified_base (268)..(268): a, c, t, g, unknown or other
  modified_base (370)..(370): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggtctttttcttgtggcttaattttaaaaggtgtccagtgtgaagtgctagttgttggattcgtgggggagcttgggtacgagggcccgggggggtcctgagactctcctgtgcagtcttcaggtnttcgagtctttagcagctacgccatgagcgtcggtccgcaggcctccgaggggaaggactgggagtgggctcgtaggtagttggtgctggtgtcgagaccanactactaacgcaacgactccggaggacgggtcccgtacaccagtctacgaagacgaactaacttacccaaacggtaaccctacccttggtaccttcgtaacgaacaaaacgttacgggaaacccgtaaaccgtaggaacgggacgacccggaaacgggaccgtaaacccgggtaccccttaagtttaacgttaaccggttaaaggtaaaccggtaaaaacttcggggtaaacccttaaaccggggtaaacttaaggttaacgttaaccgtttaaacgttaacgggttaacggggttaacccgtttacgggttaaccgtttacggtaacgtttcccgtttaacccgggggg

SEQ ID NO: 434142 - DNA, 595 bp, Homo sapiens
  misc_feature: GZ8MTXP01CRICJ.39.9.A09.1.454.CMB.2.raw
  modified_base (260)..(260): a, c, t, g, unknown or other
  modified_base (478)..(478): a, c, t, g, unknown or other
tcagtcgcactagtcacgaccggtgctcgatttagcgagacgcgcaggggggagagaggagcccagccctgggattttcaggtgttttcatttggtgatcaggactgaacagagagatctcaccatggaatttgggctgagctggtctttttcttgtggctaattttaaaaggtgtccagtgtgaagtgcagttgtggattcgtgggggagcttggtacaggccggggggtcctgagactctcctgtgcagcttcaggtnttcagtcttagcagctacgccatgacgcgtcgggtcccgccgaggcctaccggaaggggaagggcgtgggaggtggggtctacgtagggtagttgggtggctaggtcggtagacggacataacgtactaacggcaacggacctccggtagggaaccggggtccgtacacatctaccaagacactaaactacccaaagtaccctacctgtacctcgaanaacaaatacgaaactacgagacgacgacgaacgacgacgtactatatacagtaaacaagttcgacagatattacgttacttacgtaagtaggtaacttgtacttcgtcgttcgtcgg

SEQ ID NO: 434143 - DNA, 830 bp, Homo sapiens
  misc_feature: GZ8MTXP01A1QYM.39.9.A09.1.454.CMB.2.raw
  modified_base (391)..(391): a, c, t, g, unknown or other
tcagtcgcactagtcacgaccggtgctcgatttagcgagacgcgcaggggggagagaggagcccagccctgggattttcaggtgttttcatttggtgatcaggactgaacagagagatctcaccatggaatttgggctgagctggtctttttcttgtggcttattttaaaaggtgtccagtgtgaagtgctagttgttggattcgtgggggaggcttggtacaggccgggggggtcctggagctctcctgtgcagtcttcaggtattcagtctttagcagtcacgcatgacgtcgtcgggtccgccgaggcctaccggaaggggacggggacgtagggtaggtgggtcctacgtaaggttgttagggtggcgtagtggtacgacgaccaanactaccgtaacgcgaacgtacccgtcgggtacgggaaccgggtcccgtttccgaaacccgtacttaccctaacccgaagggaaacctaaccgtaaaacgtttacccgaaaaccggtaaacccctaccccgttaacggttaccttacccgttaaggaaacctaaaacgttacggggaaaaaccccgttaaacccggttagggaaccgggaaaccgggtaccccgggaaacgggtaaccccgaaacccgggttacccccgttaaattaaacgttttaaacccgtaaacggttaaaaccggtaaaaaccgttcgggggtaaaccccttaaacggggtaaacttaaggttaaccggttacgttaaacccggtttaagggttacggggttaacccggtttcggttaaaccggtttccggtaaccgtttccgggtttcccggggg

SEQ ID NO: 434144 - DNA, 645 bp, Homo sapiens
  misc_feature: GZ8MTXP02IG6PN.39.9.A09.1.454.CMB.2.raw
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggtctttttcttgtggctattttaaaaggtgtccagtgtgaagtgcagttgttggattcgtgggggaggcttggtacaggccggggggtcctgagactctcctgtgcagcttcaggattcagcttagcagctacgccatgagctggccgccaggctccgagggacggactggagtgggtctgaggttagttggtggcaggtggtgagaccacatacgtacgcagacctccgtagaacggggtcccgttacgacctagtccctaccgagtaacgacaacttacccaaagaaccctaaccctgtacctctacgaactaaaactacgaaaaccaaccgtaggaacgacgacccggaacgggaaccgacccggaccctaagttacttacgtaacgttaaacgaaaagttcggaaccctaaacgggtattaacgtacgtaaaccgttacgttaagtttacggggaaaccgtttcggtaaaccgtttcggaacgtttaccgttccgggg

SEQ ID NO: 434145 - DNA, 600 bp, Homo sapiens
  misc_feature: GZ8MTXP02HI2R9.39.9.A09.1.454.CMB.2.raw
  modified_base (292)..(292): a, c, t, g, unknown or other
  modified_base (333)..(333): a, c, t, g, unknown or other
  modified_base (397)..(397): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagcgtggtcgttttctgtggctattttaaaaggtgtccagtgtgaagtgcagttgttggattcgtgggggaggcttgggtacaggccggggggtcctgagactctcctgtgcagcttcaggattcagtcttagcagctacgcatgagctggccncaggctccgagggaggctggagtgggtctcgaggtattggngcaggtggtgacgaccacatacacgcagactcggtgacggccgttacaccatcctaccgagganacaattccaaagtaccacccgtgtcctacgtacgaactaaacgtacgaaacctaacgaggaacggaccgaccggaacggtaccgacggtacttagtttactacgtacggacgacggaggaaacggaagggtacggtcggggtaccggttacgaacgtccgggcggggaccggaacgggtacccgtcggtacccgtaccgtccg

SEQ ID NO: 434146 - DNA, 393 bp, Homo sapiens
  misc_feature: GZ8MTXP02JUY6D.39.9.A09.1.454.CMB.2.raw
  modified_base (388)..(393): a, c, t, g, unknown or other
tcagtcgcactagtcacgaccggtgctcgatttagcgagacgcgcagggtggctgacgtgccagacttggagccagagaatcggtcaggaatcccaggtacagcccccaaactcctcatttatgacgatgataagcgactctctgggattcctgaccgattctctggctccaagtctggcacgtcagccaccctgggctcaccggactccagtctggggacaggccgattattactgcgcagcatgggatacctccctgagtggtggggtgttcggcggaggaccaaggctgaccgtcctaggtcagcccaaggctcgccccctggtcactctcgttccccgcctcctccactagtcgcgactgagcggggctgggcaaggcgcatgnnnnnn

SEQ ID NO: 434147 - DNA, 645 bp, Homo sapiens
  misc_feature: GZ8MTXP02JO21A.39.9.A09.1.454.CMB.2.raw
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggtctttttcttgtggctaattttaaaaggtgtccagtgtgaagtgcagttgttggattcgtgggggaggcttggtacaggccggggggtccctggagactctcctgtgcagcttcaggattcagtcttagcagctacgccatgagcgtcgggtccgccaggcctccgaggggaacgggctggaggtgggtctcgaggttagttgggtggcgtaggtggtacgacgaccgacaatacgtacgcacgaccgttcggaggaacggggccgttacacctatcctaccagacgaacaaacttcccaaaacgaacccaccccttgtccctacttacgaaaccaaattacggaaaccaaccgtacggaacggaacgacccggaacggtaaccgacccggtacccgttattaacttaacgtaacgtaaaacgtaaaacgtcggaccgtaacggatactacgtaacctagtaagttcggaacgttacggtacttacgtacttcgtaccggg

SEQ ID NO: 434148 - DNA, 689 bp, Homo sapiens
  misc_feature: GZ8MTXP02J1UEO.39.9.A09.1.454.CMB.2.raw
  modified_base (360)..(360): a, c, t, g, unknown or other
tcagtcgcactagtcacgaccggtgctcgatttagcgagacgcgcagggggagagaggagcccagccctgggattttcaggttttttcatttggtgatcaggactgaacagagagatctcaccatggaatttgggctgagctggtctttttcttgtggctattttaaaaggtgtccagtgtgaagtgcagttgttggattcgtgggggagcttggtacaggccggggggtccctgagactctcctgtgcagcttcaggattcagtctttagcagctacgccatgagctggtccgcaggctccgaggggaacggacgtggagtgggtctcgagggtattgggtggcagtggtgacgaccanatactacgcagaccgtccgtggaaacgggtccgttcaacccatccctaccgagagactaaagttacccaaagaacccacccgtgtcctacgtacgaactaaaacgtacgaaaacctaaacccgtagaaacggacggacccggaacggaacccgtaaccgggaccccttaattaacgtttaaacctacggtaaaacgtaaaaacgtccgggggaaccctaaacggggaaacttaactacggtaaacccttaaacgttaaggttaacggggtaaacccgttaggggttaaccctttacggggaacctttacgttaccggggttcccggggg

SEQ ID NO: 434149 - DNA, 685 bp, Homo sapiens
  misc_feature: GZ8MTXP02IKTID.39.9.A09.1.454.CMB.2.raw
tcagtcgcactagtcacgaccggtgctcgatttagcgagacgcgcagggggagagaggagcccagccctgggattttcaggttttttcatttggtgatcaggactgaacagagagatctcaccatggaatttgggctgagctggtctttttcttgtggctattttaaaaggtgtccagtgtgaagtgctagttgttggattcgtggggggaggtcgttgggtacgagggccgggggggtccctggacgtacctctcctggtgcagtcttcgaggtattcagtctttagcagctacgccatgacgcgtcgggtccgccgacggccgtaccgaggggaaacgggaccgtaggggaggtcggggtctcggtaagggttagttgggtggtcgtaggtgggtacgaaccgaccactataaccgtacgacacggtaccgtccggtagggtaaaccggggtcccgttaccaaccgtactcctaccgagaacgtaacaaacttacccgaaacgtaaacctaccccgttagtaccttacgacgaactaaaacgtacgaaaccaaccgtagacgacgaccgagaccgaccggtactatacttacgacgtaacgaaacgtggacctacggtaatacgttacgtaactacgtaaggttggaacgttacgttacgtacgtacttcgtacggtccgggg

SEQ ID NO: 434150 - DNA, 578 bp, Homo sapiens
  misc_feature: GZ8MTXP02J0J1A.39.9.A09.1.454.CMB.2.raw
  modified_base (292)..(292): a, c, t, g, unknown or other
  modified_base (335)..(335): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggcttttcttgtggctattttaaaaggtgtccagtgtgaagtgcagttgttggattcgtgggggaggcttggtacaggccggggggtcctgagactctcctgtgcagcttcaggattcagctttagcagctacgccatgagctgggtccncaggctccgagggacggctggagtgggtctcgaggtattgggnggctaggtggtcgagtaccagactactacggcagtaccgtccggtaggaacggggtccgttacaccatccctaccgagacgaactaacttccgaaacgaaccacccttgctctagacaaatcaaacacgtagacgagacgaacggacacggaccctatactacgagtaacgaaaactggaccctaagagtacacgtaacttacgtaagtcggggtaactacggttaccttcgtactcgtccgg

SEQ ID NO: 434151 - DNA, 538 bp, Homo sapiens
  misc_feature: GZ8MTXP02IWDGL.39.9.A09.1.454.CMB.2.raw
  modified_base (336)..(336): a, c, t, g, unknown or other
  modified_base (354)..(354): a, c, t, g, unknown or other
  modified_base (430)..(430): a, c, t, g, unknown or other
  modified_base (478)..(478): a, c, t, g, unknown or other
tcagtcgcactagtcacgaccggtgctcgatttagcgagacgcgcagggggagagaggagcccagccctgggatttcaggtgttttcatttggtgatcaggactgaacagagagatctcaccatggaatttgggctgagctggtctttttcttgtggctattttaaaaggtgtccagtgtgaagtgcagttgttggattcgtgggggaggcttggtacaggccggggggtcctgagactctcctgtgcagcttcaggattcagcttagcagctacgccatgagctgggtccgccaggctccgagggaaggactggagtgggtctcgaggtattggnggcaggtggtgagaccanatactacgcagactccggtaggaaacgggtccgttacaccatcctccagagaacaattccaaagaccaccctgtcnctgacaaatcgaaacaacctgacgagaccgagacacggtccatatacngtaacaaaatggacctaggatagacgtactataagtcggactaggtactcgtatcgtcgg

SEQ ID NO: 434152 - DNA, 731 bp, Homo sapiens
  misc_feature: GZ8MTXP02IDE5J.39.9.A09.1.454.CMB.2.raw
  modified_base (387)..(387): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggctttttcttgtggctattttaaaaggtgtccagtgtgaagtgcagttgttggattcgtgggggaggcttggtacgaggccggggggtcctgagactctcctgtgcagcttcgaggattcagtctttagcagctacgccatgagcgtcgggtccgccgaggcctccgaaggggaaggacgtgggagtggggtctcgaggttatgggtggcaggtggtgacgaccacatactacgcagacgtcgnggacgggtccgttacacctactcctaccgagacgactaacttacccaaagaacccacccttgtcctcgtacgaactaaaacgtacgaaaacctaaaccgtaggaacggaacgacccggaaacgggaacccgaaccggggtacccccttaaagttaaccgtttaaaccgtaaacggttaaaaccggtaaaaaacggtttccggggtaaaccctttaaacgggggaaactttaaacgttaaccggtaaaccttttaaaacgtttaaacggggttttcgggggtaaacccgttttacggggttaaacccgttttaccggtaaacgttttcccggtttaccccggggg

SEQ ID NO: 434153 - DNA, 651 bp, Homo sapiens
  misc_feature: GZ8MTXP02FTTH9.39.9.A09.1.454.CMB.2.raw
  modified_base (350)..(350): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagcgtggtcgttttcttgtggctattttaaaaggtgtccagtgtgaagtgcagttgttggattctgggggagcttggtacagccggggggtcctgagactctcctgtgcagcttcaggattcagctttagcagctacgccatgagctggtccgcaggctccagggaaggactggagtgggtctcgaggtattggtgcagtggtgagaccaanatacgacgcagactcggtaggacggggtccgttacaacctatacctaccgaagaacgaacctaaacttaacccgaaaacgaaaccctaccccgttgtaccctactacgtaactaaactaacgaaaccgtaaaccgtaagaacggaacgaccggaacggaaccgaaccggtaccgtaactaacgttaacgtaacgtaaacgtaaaacgtaacggtaccgtaaacggtaacgtaacgtaacgtaaccgttaacgttaacggttacggtaacggttacggttacgttacggtacgtacgtacgg

SEQ ID NO: 434154 - DNA, 702 bp, Homo sapiens
  misc_feature: GZ8MTXP02HK3TG.39.9.A09.1.454.CMB.2.raw
  modified_base (303)..(303): a, c, t, g, unknown or other
  modified_base (353)..(353): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggtctttttcttgtggcttattttaaaaggtgtccagtgtgaagtgcagttgttggattcgtgggggaggtcttggtacagggccggggggtccctgagactctcctgtgcagtcttcgaggtattcagtcttagcagctacgccatgagcgtcgggtccncgaggcctaccgaggggaacggcgtggagtgggtctcgtaggtagttggnggctagggtggtcgacgaccactactacacggacacggaccgtccggtagggacggggtcccggttacaaccctctcccgtaccgaagaacgaaacctaacttacccgaaaacgtaaaccctacccgttacggttacctacctacggaacctaaaacttacggaaaaccctaaccgtaggaaacgggaccgaacccgggaacggaacccgtaaccggtaccttaattaacgttaacgtacggtaaaacgtaaaacgtcggtaacccgtaaacggtaactaacgtaccgtaacgttaacgtaaggttcggaacgttcgggttaaaccttcgtaacgtttcggttacgggg

SEQ ID NO: 434155 - DNA, 786 bp, Homo sapiens
  misc_feature: GZ8MTXP02GPJ8N.39.9.A09.1.454.CMB.2.raw
  modified_base (273)..(273): a, c, t, g, unknown or other
  modified_base (293)..(293): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggtctttttcttgtggcttaattttaaaaggtgtccagtgtgaagtgctagttgttggattcgtgggggaggcgttggtacgagggccgggggggtccctggacgtactctccgtgtgcagtcttcaggtnttcagtctttagcagctacnccatcgagtcgtcgggtccgccgaggcctaccggaagggggaacggggaccgtaggggtaaggttcgggggttaccttacggtaaggggtttaggtttcggggtggggtcgtaaggggttcgggtaggaacggtaacccaactaacgttaacgtaccggactacggaacccgttcccgggtaagggaaaccgggggttcccggtttaacccgaaccctacgttaccctacccgaaaagtacgaaaccctaaactttaccccgaaaaacggtaacccctaaaccccgttcggtaccctacttacggaaacctaaaaggtacgaaaaccttaaccgtaggaaaccggacgacccggaagacccgtaacggacccttagtaacttacgacgttaaaacgaaaagttcggaaccttaacggaataacgtacgtaaccgttaataacggtttacgggaaccgtttacggttacgttaccgtagttaccggttccgggg

SEQ ID NO: 434156 - DNA, 614 bp, Homo sapiens
  misc_feature: GZ8MTXP02JSK98.39.9.A09.1.454.CMB.2.raw
  modified_base (301)..(301): a, c, t, g, unknown or other
  modified_base (366)..(366): a, c, t, g, unknown or other
tcagtcgcactagtcacgaccggtgctcgatttagcgagacgcgcagggggagagaggagcccagccctgggattttcaggttttttcatttggtgatcaggactgaacagagagatctcaccatggaatttgggctgagctggctttttcttgtggcttattttaaaaggtgtccagtgtgaagtgcagttgttggattcgtggggggaggcttggtacagggccgggggggtcctggagactctcctgtgcagcttcgaggtattcagtctttagcagctacgccatgagctgggtccnccaggctccgaggggaaggctggagtgggtctcgagggtattgggtgcgaggtggtgacgaccanatacgtacgcagtccgtccgtaggaaacggggtccgttacaccgtagtcctaccgagacgaactaaacttacccaaagaaccaccccgtgttcctactacgaacaaacgttacgaaaccaaccgtgaaacgacggaccgaagaccgacggaccctaatacttacgtagtaaccgaaaagtcggacctacggatacgtacgtaacctagttagtcggtactacggtacttacgactcgtacgtccgggg

SEQ ID NO: 434157 - DNA, 764 bp, Homo sapiens
  misc_feature: GZ8MTXP02IL2LA.39.9.A09.1.454.CMB.2.raw
  modified_base (302)..(302): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggtctttttcttgtggctattttaaaaggtgtccagtgtgaagtgcagttgttggattcgtggggggaggcttgggtacagggcccggggggtccctggagactctcctgtgcagcttcaggtattcagtcttagcagctacgcatgagtcgtgggtccnccgaggcctccggaaggggaacggacgtggaggtggggtcctacgtagggttagttgggtaggcgtaggtgggtacgaacgaccaactagttacctaacggcaggtactcccggtaggggaaaccgggtcccgggttacaaccgtactccgtaccgaagaacgaaacaaacttaacccgaaaacggtaaaccctacccttacgttacctaccttaggaacctaaaaacggttacgaaaaccctaacccgttagggaaacggaaccgggaccccgggtaaagggaaacccgaacccgggtacccctttaaagtttaaaccttaaaacccgttagggtaaaaacccggtaaaagttacggaaccccgtttaaacgggaaacttacgtaacgtaacttaaaccgttaagtttaccggggaactttcgggttaaacctttcggttaaacgtcgtttaacccggggg

SEQ ID NO: 434158 - DNA, 767 bp, Homo sapiens
  misc_feature: GZ8MTXP02G75AU.39.9.A09.1.454.CMB.2.raw
  modified_base (188)..(188): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggtctttttcttgtggctattttaaaaggtgtccagtgtgaagtgnagttgttggattcgtgggggaggtcttggtacagggccggggggttccctggagactctccgtgtgcagtcttcgaggtattccgagtctttagcagctacgccatgagcgtcggtccgcgaggcctccgaaggggaacggacgtggaggtgggtctcgaggttagttgggtggcgtaggtgggtacgacgacccgtacgtataacgtaccggacgtacggtacccgttccgggtaggggtaaaccgggggtcccggtttaccaaacccgtaacgttccctacccgaaaggaaacgtaaccgtaaacgtttaccccggaaacgaaacccccgtaaccccgttcgttaccttacccgttacgaaacccgtaaaaagttaccggaaaaacccgttaaccgtaacgggaaacggaaccgggtaaccccggaaacggaacccgtaacccgggtaaccccgttaatttaaacccgttaacgtaacgttaaaaccggaaaagttcccggaaccgtaaacggtactagtacgtaaccttactaaggtacgggtaacttacgggtaactcgtaacgttccgtcgggg

SEQ ID NO: 434159 - DNA, 724 bp, Homo sapiens
  misc_feature: GZ8MTXP02IWEJP.39.9.A09.1.454.CMB.2.raw
  modified_base (287)..(287): a, c, t, g, unknown or other
tcagtcgcactagtcacgaccggtgctcgatttagcgagacgcgcagggggagagaggagcccagccctgggattttcaggttttttcatttggtgatcaggactgaacagagagatctcaccatggaatttgggctgagctggtctttttcttgtggcttaattttaaaaggtgtccagtgtgaagtgctagtttgttggattcgtgggggaggtcgttggtacgagggccgggggtcctcgagactctctgtgcagctcagattctagtcttagcagactcaccntgagcgtcggtccgccgacgcgtccggacggggaagggacgtggtaggtgggtcgtacgtaggtagttgggtggtcgtaggtggtaggaccgaccactacgtactacgactacgacgtccgtacggaacgggtaccggttaccactactaccgtacccgaaagtaccgaaactaacgttacccaaacgaaaccctcctcgtactccgagaaccaaaatcgaaacctaaccggtgaaccggcggaaccggacggtaacccgaccgtacccttaaaacgtttattaccggttacgacggtaaccgtaaaaccttcccggttaccccgtaagtttacgggttacgggtttaacccgacccctaaaccggttttaaacgttcgggtaaccccttacccggggccggggtaaaccgtaccgggggttaaacccccttccggg

SEQ ID NO: 434160 - DNA, 640 bp, Homo sapiens
  misc_feature: GZ8MTXP02HKDE3.39.9.A09.1.454.CMB.2.raw
  modified_base (297)..(297): a, c, t, g, unknown or other
  modified_base (343)..(343): a, c, t, g, unknown or other
  modified_base (362)..(362): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggcttttctgtggctattttaaaaggtgtccagtgtgaagtgctagttgttggattcgtgggggagcttggtacagggccggggggtccctggagactctcctgtgcagcttcgaggtattcagtcttagcagctacgccatgagcgtgggtccnccaggcctccgagggaaggctggagtgggtctcgaggttattgggngctaggtggtgacgaccanatactacgcagcctcggtggaacgggtccggttacaaccgtactcctaccaagacacaagttcccgaagaacctaccctgtcctactgaactaaagtacgaaacctacgtagacggaacgccggaacggaccgaaccgggtacccttaagttaaacgttaccgtaaaggttaaaaccgaaaaacggttccgggaaccccttaaagggaacttacgtaacggtaaccttaacgtaagttacgggtacttacgggtaactttcggatttccgtaccgggg

SEQ ID NO: 434161 - DNA, 626 bp, Homo sapiens
  misc_feature: GZ8MTXP02I9AU8.39.9.A09.1.454.CMB.2.raw
  modified_base (381)..(381): a, c, t, g, unknown or other
  modified_base (495)..(495): a, c, t, g, unknown or other
  modified_base (500)..(500): a, c, t, g, unknown or other
tcagtcgcactagtcacgaccggtgctcgatttagcgagacgcgcagggggagagaggagcccagccctgggattttcaggttgttttcatttggtgatcaggactgaacagagagatctcaccatggaatttgggctgagctggtctttttcttgtggcttaattttaaaaggtgtccagtgtagaagtgctagttgttggattcgtgggggagtcgttggtacgagggcccggggggtcctggacgactctcctgtgcagtcttcgaggtattcagtcttagcagctacgcatgacgtcgtcgggtcccgaccgaggcctaccggaaggggaaacggtcgtaggggacggttggggtcctacggtaggttagttggggnggtcgtaggttggacgaacgacccaactaataccgtacgcgacggtacctccgggtaggaaccgggtcccgttacacctatcccacaagaacactaactacccgaaataacccncgtcnctcgagaacaaagtcaaactagagagacgcgagacacgactataactagacgtaaacgaaagcgtaacgtaagtactagtacaacttaataagtcggtacttacggtacttacggacttcggtcgg

SEQ ID NO: 434162 - DNA, 805 bp, Homo sapiens
  misc_feature: GZ8MTXP02IRJNL.39.9.A09.1.454.CMB.2.raw
tcagtcgcactagtcacgaccggtgctcgatttagcgagacgcgcagggggagagaggagcccagccctgggattttctaggttttttcatttggtgatcaggactgaacagagagatctcaccatggaatttgggctgagctggtctttttctgtggtcttaagttttaaaaggtgtccagtgtagaagtgctaggtttgttggtattcggtggggggaggtcgttggtaccgacggggccgggggggtccctggacgtaccttctccgtggtcgctagtcttcgaggtattcgagttcgtttacgctagtacctaccggacctagtacggacggtccggttcgggtcccccgaccggtacgggtcccgtaccggaaagggggtaacgggacggtaggggagggttcgggtccgttacggtaaggggtttagttaggggtcggacgtaggtgggtacgtaacccggaaccaactacgtaacctaacgctaacgaccgtccggtagggaaaccggggtccctaccgacctactcccaagaacgaaactaacgtaacctaaaaccgaaccctacccgtactccgttacacgaacgaaacttaacgaaaccctaaaccgaacggtacgaaccggaccggaaacggaacccgtacccggaaccttaaacgttaacttaacgtacgtaaaacggaaaacgttaacggtacccgaaaggttaacctaaagttaccgtacgttaaaccgtaaggttacggtaacccgttaggttaccgtaacggtacttaccggtcggttaccggggtcgg

SEQ ID NO: 434163 - DNA, 730 bp, Homo sapiens
  misc_feature: GZ8MTXP02HFRN6.39.9.A09.1.454.CMB.2.raw
  modified_base (261)..(261): a, c, t, g, unknown or other
  modified_base (296)..(296): a, c, t, g, unknown or other
  modified_base (359)..(359): a, c, t, g, unknown or other
tcagtcgcactagtcacgaccggtgctcgatttagcgagacgcgcagggggagagaggagcccagccctgggattttcaggtgttttcatttggtgatcaggactgaacagagagatctcaccatggaatttgggctgagctggtctttttcttgtggctattttaaaaggtgtccagtgtgaagtgcagttgttggattcgtgggggaggcttggtacaggccggggggtcctgacgactctcctgtgcagcttcgaggnttcagctttagcagctacgccatgagctcggtccnccgaggctccgaagggaacggctggaggtcgggtactcgaggttattgggtggacaggttggngacgacccacgtactacgtacgcacgacctccggtaggaaacggggcccgttacgacctacgtcctaccgaggaacgaacaaacttacccgaaaacgaaacccacccgtgtaccctactacgaaacctaaagtacggaaacccaaccgtagaacgggaacgacccggtaaacgggaccgaaaccggaccccttaaagttaacgtttaaaccgtacggttaaaacgggtaaaaaactttcggggaaacccccgttaaaggggaattaaaacgttacgggtaaacctttaaacgtttaaaccggtttagggggtaaaccgtttaccgggggtttaaactttacccggtaaacgttttacccgtttcccggggg

SEQ ID NO: 434164 - DNA, 565 bp, Homo sapiens
  misc_feature: GZ8MTXP01BZLNC.9.63.F08.1.454.CMB.2.raw
  modified_base (300)..(300): a, c, t, g, unknown or other
  modified_base (367)..(367): a, c, t, g, unknown or other
  modified_base (394)..(394): a, c, t, g, unknown or other
  modified_base (404)..(404): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatccaacccttacaccggtcgcccaaactatgcagcgtctttcggacagggtcaccctgacctgggaccncgtcccgcaatacagcctcatggaattgaccacactgaaaactctagacgacacggcctctctatgngcgagggtcaatagtctacataacggngccggacagntgtattttgatgtctggggcgaaggtacaggcggtcacccgtcgcctccgcgtccctacccgaccgaacgggcccagttccgggtcccttcccccgtcggcccttaccccgttccttaccgaacgaccggccacccgtcgttcgggggtccaacgaaccgg

SEQ ID NO: 434165 - DNA, 596 bp, Homo sapiens
  misc_feature: GZ8MTXP01C0XHM.9.63.F08.1.454.CMB.2.raw
  modified_base (371)..(371): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggccttgagtggctgggctggatcaacccttacaccggtcgacccaaatatgcagcgtctttcggacagggtcacccgtgacctgggacgcgtcccgacaatacagccctcattggaattcgaccacactgaaactctagacgacacggcccttctctattgngacgagggtactaatacgtacttaaccagtaaacggtcgaccggacagtattgtatttttggagtgtacgtcggggacgtaaacgggtacgaggtccggtaccgacccgtcgcctaccgacgtccctaccacccgacgggccctacgttccggtcccttccccgtcggtcccttaccccgttccttacccgaagacgccgaccgtcggttcgggccgaacgccgg

SEQ ID NO: 434166 - DNA, 568 bp, Homo sapiens
  misc_feature: GZ8MTXP01BHF37.9.63.F08.1.454.CMB.2.raw
  modified_base (308)..(308): a, c, t, g, unknown or other
  modified_base (403)..(403): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggccttgagtggctgggctggatccaacccttacaccggtcgcccaaactatgcagcgtcttttcggaacagggtcaccctgacctgggacgcgtcccgnaatacagcctccatggaattgaccacactgaaactctgacgacacggccgtctaactatgtgcgagggtcaatagtcttacataaacgtgccganagatgtattttgatgtcgtgggccgaaggtacagcggtcaccgtcgcctcgacgtcctccgaccgaacgggccccaagttcccgggtcctttcccccgtcgggtccccaccccgttcccttacccaaagccggcctaaccgtcgttcggggggccaacgcccggg

SEQ ID NO: 434167 - DNA, 592 bp, Homo sapiens
  misc_feature: GZ8MTXP01B5W5G.9.63.F08.1.454.CMB.2.raw
  modified_base (309)..(309): a, c, t, g, unknown or other
  modified_base (335)..(335): a, c, t, g, unknown or other
  modified_base (482)..(482): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctcagtgcaagtctcctgccaggcctctggatatacataccgcgaccactacatacagtggtgcgcctggcccctggacgaggccttgagtggctgggctggatccaacccttcaccggtcgacccaaactatgcagcgttctttcggaacagggtccaccctgacctgggacgccgtcccgnaatacagcctcatggaattcgaccanactgaaactctagacgacacggccgttactcgtattgtcgcgaggggtacaattacgtcttaacgagtaaacggtcgccggacagtattgtagtttttggattgtcgtaggggacgaaggttacgagtcggtcaccgtccgccgtcncgtcctcccaccgacgggccctacgttccggtccttcccccgtcggcccttaccccgttcccttacccaacgaccgccgtacccgtcggttcgggggccgccgaaccggg

SEQ ID NO: 434168 - DNA, 717 bp, Homo sapiens
  misc_feature: GZ8MTXP01ES3X4.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggccttgagtggctgggctggatcaacccttacaccggtcgccaaactatgcagcgtctttcggaacagggtcaccctgaccgtgggaccgcgtcccgcaatacagcctccattggaaattcgaccacactagaaactcgtagacgaccaccggtccgttactaacgttagtttggcgtcggtaagggggttccaaatttacgttaccttaaaccgtaagtaaaaccgggtacggacccggtaacgtaaaggtaacgttaggttagttttttagggaagttcgggttacgttacgggggtaccggtaaaggggttaccgtaacggtccgggtaccgtaacccggtccggacccttaccgacgtccctacccgaacccgaaaccggggtcccctaacgttcccgggtcccgtttcccccgtcgggttccccaaccccgttccccttaccccgtaaaccggacggtccctaacccgttccggttccggggggtccaaccggtaacccgggg

SEQ ID NO: 434169 - DNA, 728 bp, Homo sapiens
  misc_feature: GZ8MTXP01D82TT.9.63.F08.1.454.CMB.2.raw
  modified_base (209)..(209): a, c, t, g, unknown or other
  modified_base (261)..(261): a, c, t, g, unknown or other
  modified_base (303)..(303): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgnggccttgagtggctgggctggactccaacccttacacccggtcacccaaatntgcagcgtctttcggaacagggtcaccctgaccgtgggaccnccgtccgacaataccagcctcatggaattcgaaccacactagaaaccctcgtagaaccgaccaaccggtcccgttactaacgttagtttcggtacggacgggtaaggggtacctaaagtttacggttacctttaaacccgtaaagttaaaaccggggtcgtaccccgggtaagtaacggttaagtttggtttaacgttttttagggagttcggttacgggttacgggggaccggtaaaggggttaccgaacgggtccgggtaccgtacccggtccgtcccgttaccaccggtccccttaccccgaacccgaccggggcccctacgttcccgggttccccttcccccgtccgggtccccttaccccgttcccttaccgaacgaccgcccgtaccgtccggttaccggggtaaccaacggtcccggg

SEQ ID NO: 434170 - DNA, 551 bp, Homo sapiens
  misc_feature: GZ8MTXP01AFHAQ.9.63.F08.1.454.CMB.2.raw
  modified_base (298)..(298): a, c, t, g, unknown or other
  modified_base (306)..(306): a, c, t, g, unknown or other
  modified_base (331)..(331): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggccttgagtggctgggctggatcaacccttacaccggtcgcccaaactatgcagcgtctttcggaacagggtcaccctgacctgggacncgtcccgnaatacagcctcatggaattgaccanactgaaactctgacgacacggcctctaactattgtgcgagggtcaaatagtcttaacataaacgggtgacccggacagatgtatttttgatgtgtgggccgaaggtacagcgggtcaccgtcgcctcacgcctaccaccgaagggcccaattccggtccttcccccgtggcccaccccttcccaccgaacgcgcaccgtcgcgggggccaacgaaccggg

SEQ ID NO: 434171 - DNA, 563 bp, Homo sapiens
  misc_feature: GZ8MTXP01AEEEN.9.63.F08.1.454.CMB.2.raw
  modified_base (298)..(298): a, c, t, g, unknown or other
  modified_base (306)..(306): a, c, t, g, unknown or other
  modified_base (369)..(369): a, c, t, g, unknown or other
  modified_base (410)..(410): a, c, t, g, unknown or other
  modified_base (461)..(461): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctgggcctcagtgcaagtctcctgccaggcctctggatatacataccgcgaccactacatacagtggtgcgcctggcccctggacgaggccttgagtggctgggctggatccaacccttacaccggtcgcccaaactatgcagcgtctttcggaacagggtcaccctgacctgggacncgtcccgnaatcagcctcatggaattgaccacactgaaactctagacgacacggacccgtctaactattgngcgagggtcaaatagtcttaaccataaacggtgacccgganacgatgtattttgatgtcgtggggccaaggtcagcggtcaccgtcgcctcncgtcctccaccaacggggcccagttccggttccttcccccgtgggcccttacccgttcccttccgaacgacgccaccctcggttcgggggccaacgcccggg

SEQ ID NO: 434172 - DNA, 733 bp, Homo sapiens
  misc_feature: GZ8MTXP01C11XR.9.63.F08.1.454.CMB.2.raw
  modified_base (306)..(306): a, c, t, g, unknown or other
  modified_base (315)..(315): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctcagtgcaagtctcctgccaggcctctggatatacataccgcgaccactacatacaggtggtgcgcctggcccctggacgaggccttggagtggctgggctggactccaacccttacgaccggtcgacccaaactatgcagcgttctttcggaacacgggtccacctgacctgggaccncgtcccganaatacacgcctcatggaattcgaccacactagtaaactctagacgtaaccgaccggtacccgttctaacgttacgttgggtacgggcgggtaaggggtactaaagttacggttacctttaaaccgtaacggtaaaccgggtacggaccccggaacgaaggttagtttagtttagttttttacgggattcggttacgggttacgggggtaccggtaaacggggttaccggacggtaccgggtacccgtaaccccggttcccgtacccgttaccgaccgtccccgtacccgaacccgaaaccgggggtcccctacgttccccgggtttccccttcccccgttcgggccccttacccccgttcccttacccgaacggaccggtcctacccggtcggttacgggggtcccaacggtcccggg

SEQ ID NO: 434173 - DNA, 548 bp, Homo sapiens
  misc_feature: GZ8MTXP01BUS19.9.63.F08.1.454.CMB.2.raw
  modified_base (276)..(276): a, c, t, g, unknown or other
  modified_base (406)..(406): a, c, t, g, unknown or other
  modified_base (454)..(454): a, c, t, g, unknown or other
  modified_base (543)..(543): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctcagtgcaagtctcctgccaggcctctggatatacataccgcgaccactacatacagtgggtgcgcctggcccctggacgaggccttggagtggctgggctggatcaacccttcaccggtcgccaaactatgcagcgtctttcggaacngggtcaccctgacctgggacgcgtcccgcaactacagcctaccatggaacttgaccacactgaaactctagacgacacggcccgtctctatgtgcgtaggtcaatagtcttacataacggtcgcccgganacgattgtagttttggatgtcgtgggcgaaggtcgagcgtcaccgtcnctcacgtccctccgaccgacggcccagttcccggtccttccccgtcgcccacccttccttaccgaacgacgccaccgtcgttcggggcncgcgg

SEQ ID NO: 434174 - DNA, 739 bp, Homo sapiens
  misc_feature: GZ8MTXP01A5QZH.9.63.F08.1.454.CMB.2.raw
  modified_base (190)..(190): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtncgcctggcccctggacgaggccttgagtggctgggctggatccaacccttacgacccggtcgacccaaactatgcagcgtctttacggacagggtccaccgtgaccgtgggaccgccgtcccgacaatacacgtcctaccgattggtaacttcggaaccacactagaaactcgtagaccgacaccgggtccttactctagttggtacgcggtaggggtacctaaagttacgtacttaacctaacgtaaacccggtcgaccccggaataggtattagttagttttttggaagtttcgggtacggtacgggggaccgtaaacggggttacgaacgggtccggtaccgtaacccggtccggtacccttccgaaccgtccccgtacccgaacccggaaaccggggcccctaacggttccccggggtttacccctttccccccggttccgggaccccgttaaccccccgttccttaaccccggtaaacggtacccggaacccgtaaccccggtccgggttaccggggggtaacccttaaccggtaaccccgggg

SEQ ID NO: 434175 - DNA, 576 bp, Homo sapiens
  misc_feature: GZ8MTXP01A9GC3.9.63.F08.1.454.CMB.2.raw
  modified_base (260)..(260): a, c, t, g, unknown or other
  modified_base (298)..(298): a, c, t, g, unknown or other
  modified_base (306)..(306): a, c, t, g, unknown or other
  modified_base (332)..(332): a, c, t, g, unknown or other
  modified_base (480)..(480): a, c, t, g, unknown or other
  modified_base (568)..(568): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacacccggtcgcccaaactntgcagcgtctttcggacagggtcacctgacctgggacncgtcccgnaatacagcctcatggaacttgaccanactgaaactctgacgacacggtccctctctattggtgccggagggtcaaagttcgtacttaaccagtaaacggtcgacccggacagtattgtagttttggatgtacgtggggacgtaaggtacgacgtcggtcaccggtcgccgtccncgtccctccaccgaacgggcccacgttccgtcccttccccgtcggcccacccgttccttaccgaacgcgccaccgtcgcgggggtccncgaaccgg

SEQ ID NO: 434176 - DNA, 561 bp, Homo sapiens
  misc_feature: GZ8MTXP01BTUOZ.9.63.F08.1.454.CMB.2.raw
  modified_base (306)..(306): a, c, t, g, unknown or other
  modified_base (551)..(551): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctcagtgcaagtctcctgccaggcctctggatatacataccgcgaccactacatacagtgggtgcgcctggcccctggacgaggccttgagtggctgggctggatcaacccttacacccggtcgcccaaactatgcagcgtctttcggacagggtcaccctgacctgggacgcgtcccgnaatacagcctccatggaattgaccacactgaaactctgacgacacggcccgtctctatgtgcgagggtcaaatacgtcttacagtaaacggcgccggacagtatgtatttttggattgtcgtggggccgaaggtacagcggtcaccgtcgcctcacgtcctaccaccgaacgggcccacgttccgtcccttccccgtcggcccacccgttcccttccaacggcgccaccgtcgttcgggggtccncggaaccggg

SEQ ID NO: 434177 - DNA, 629 bp, Homo sapiens
  misc_feature: GZ8MTXP01CMRR1.9.63.F08.1.454.CMB.2.raw
  modified_base (503)..(503): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggccctggacgaggcttgagtggctgggctggactccaacccttacgaccggtcgacccaaactatgcagcgtctttacggaacagggtcaccctgaccgtgggaccgccgtcccgacaactaccacgccctccattggaacttcgaacccacactagaaactctagaccgacacggccctataacgtattgagcggagggtcaaatacgtaccttacgataacggtcgacccggacagtacttagttagtttttggattcgtcgtggggaccgaagggttacgacgtcggtacacccgtcgccgtcncgtccctaccgacccgacgggcccctaacgttcccgggttcccttcccccgtcggtccccttaccccgttcccttacccgaacgaccgccgtacccgtcggttacgggggccaaccggtaaccggg

SEQ ID NO: 434178 - DNA, 640 bp, Homo sapiens
  misc_feature: GZ8MTXP01B10RY.9.63.F08.1.454.CMB.2.raw
  modified_base (279)..(279): a, c, t, g, unknown or other
  modified_base (309)..(309): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggccttgagtggctgggctggatccaacccttacacccggtcgcccaaactatgcagcgtctttcggaacngggtcaccctgacctgggaccgcgtcccgnaatacagcctccatggaattgaccacactgaaactctagacgacacggtccgtctaactagtgtcgcgtagggtcaaagttacgtccttaacgaagtaaacggtcgacccggacagattgtagtttttggattggtcgtcggggaccgtaagggtacgacggccggtccgacccggtccgccgttaccaccgtccccgtacccgaacccgaacggggcccctaacgttcccggttccccttcccccgtcggtccccttaccccgttcccttacccgaaacggaccgtaacccgaacccgttcggacgggggtaaccaaccggtaacccggg

SEQ ID NO: 434179 - DNA, 576 bp, Homo sapiens
  misc_feature: GZ8MTXP01CO8OS.9.63.F08.1.454.CMB.2.raw
  modified_base (276)..(276): a, c, t, g, unknown or other
  modified_base (372)..(372): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctcagtgcaagtctcctgccaggcctctggatatacataccgcgaccactacatacagtggtgcgcctggcccctggacgaggcttgagtggctgggctggatcaacccttacaccggtcgacccaaactatgcagcgtctttcggaacnggtcaccctgacctgggaccgcgtcccgcaatacagcctcatggaattgaccacgactagaaactctagacgtacaccggccgtactaactattgngcgagggtcaaagtacgtacttaccaacgtaaacggtcgaccggacagtagtgtatttttggattgtcgtacggggacgtaagggttacgaggccggtacaccgtcgcctcacgcctaccaccgacgggcccacgttccggtccttccccgtcggcccacccgttccttccgaagacgccaccgtcgcggggcaacgaaccggg

SEQ ID NO: 434180 - DNA, 558 bp, Homo sapiens
  misc_feature: GZ8MTXP01CI45T.9.63.F08.1.454.CMB.2.raw
  modified_base (191)..(191): a, c, t, g, unknown or other
  modified_base (375)..(375): a, c, t, g, unknown or other
  modified_base (515)..(515): a, c, t, g, unknown or other
  modified_base (524)..(524): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatgcataccgcgaccactacatacagtgggtncgcctggcccctggacgaggccttgagtggctgggctggatcaaacccttacaccggtcgccccaaaactatgcagcgtctttcggaacagggtcaccctgacctgggacgcgtcccgcaatacacgcctacatggaattgaccactactagaaatctagacgacaacggcctctactagttgngcgagggtacaatagtacttaacaataaacggtgacccgacagatgtagtttgagtgtcgtgggggactaaggtacagcgtcaccgtcgcctcacgcctccgaccgaacgggcccacgtccggttcctccccgtcgcccnccccttccnccaacgcgccaccgttcgtaacgggggcaaccgg

SEQ ID NO: 434181 - DNA, 655 bp, Homo sapiens
  misc_feature: GZ8MTXP01DRN7V.9.63.F08.1.454.CMB.2.raw
  modified_base (260)..(260): a, c, t, g, unknown or other
  modified_base (320)..(320): a, c, t, g, unknown or other
  modified_base (352)..(352): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggccttgagtggctgggctggatccaacccttacacccggtcgacccaaatntgcagcgttcgtttcggaacacgggtccaccccgtgacccgtgggaccgccgtccccganaacgtaccagccctacataggaattcgaccanactagaaactctagaccgacaccggccgttactaactattcgaggacgtagggtacaaagttacgtacttaacaacgtaaacgggtacgccgaacgagtagttagttagtttttggagttgtcgtacggggacgtaacggtacgacggtccggtaccgtacccgttccgcccgttaccgaccgtaccctacccgaacccgaaccgggaacccctaacgttccccggttcccttcccccgttccggcccttaccccgttcccaccgtaacgcgcctaccgtcggacggggccaacgaacccggg

SEQ ID NO: 434182 - DNA, 711 bp, Homo sapiens
  misc_feature: GZ8MTXP01DXK5O.9.63.F08.1.454.CMB.2.raw
  modified_base (362)..(362): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcagtctcctgccaggcctctggatatacataccgcgaccactacatacaggtgggtgcgcctcggcccctgggacgaggtccttggagtggcgtgggctggactccaacccttacgacccggtcgacccaaactatgcagcgttcgtttacggaactagggtccacccgtggaccgtgggaccgccgtcccgacaactaccacgccctacagtaggaattcgacccanactagaaactcgtacgacgacgtaccggtacccgttacttaacgtagtttgggtacgggtacgggtaacggggtactaaagttacgttacccttaaccgtaaacgttaaaccgggtccgaccccggtaagtaaggtatttaggtttagtttttgggagtttcgggtacggtacggggaccgtaaacgggttacgacgggtccggtaccgaccgttccgacccttacgaccgtcccctaccgacccggaaccgggtccctacgttcccggttccccttccccgcggtacccttccccttccgttaccgaaccgtcgccgtaccgtcgggttcggggtcaacggtcccggg

SEQ ID NO: 434183 - DNA, 551 bp, Homo sapiens
  misc_feature: GZ8MTXP01AMS3R.9.63.F08.1.454.CMB.2.raw
  modified_base (299)..(299): a, c, t, g, unknown or other
  modified_base (307)..(307): a, c, t, g, unknown or other
  modified_base (365)..(365): a, c, t, g, unknown or other
  modified_base (405)..(405): a, c, t, g, unknown or other
  modified_base (409)..(409): a, c, t, g, unknown or other
  modified_base (502)..(502): a, c, t, g, unknown or other
  modified_base (542)..(542): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacncgtcccgnaatcagcctccatggaattgaccacactgaaactctagacgacacggcctctctatgngcgagggtcaatagtcttacgataaacggtcgacccgganacgntgtattttggatgtcgtgggccgaaggtcagcgtcaccgtcgcctcacgtcctccgaccacggcccacgttcggtcccttccccgtggtcccncccttcccttaccaacggactccgaccgtcggcggggccncgaaccggg

SEQ ID NO: 434184 - DNA, 573 bp, Homo sapiens
  misc_feature: GZ8MTXP01BEJ3T.9.63.F08.1.454.CMB.2.raw
  modified_base (277)..(277): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggccttgagtggctgggctggatcaacccttacacccggtcgcccaaactatgcagctctttcggaacngggtcacccctgacctgggaccgccgtcccgcaactacagccctcatggaattgaccacactgaaactctagacgaccacggcccgtctaacgtattgtcgcgagggtcaaattagtctacagtaacgtcgaccgacagattgtagttttgatgtcgtcgggcgaaggtacagcggtcaccgtccgcctcacgtccctacccgaccgaacgggcccctacgttcccggtcccttccccgtcggtcccaccccttccttaccgaacgacgccaccgcggttcggggcaaccgccggg

SEQ ID NO: 434185 - DNA, 759 bp, Homo sapiens
  misc_feature: GZ8MTXP01BH7LA.9.63.F08.1.454.CMB.2.raw
  modified_base (260)..(260): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgagcttgagtggctgggctggatccaacccttacgacccggtcgcccaaactntgcagcgttctttacggaacgtgggtccacccgtggaccgtgggaccgccgtacccgacaaactccaacgcctacagttaggaacttcgaacccacactagaaactcgtacgaaccgacgaccggtacccgttactaacgtagttggtcggacggtaggggtactaagttacgttaccttaacctaacgtaaacgggtcggaacccggaacgtaagtagtttagtttaagttttttggagttcggttcggtacggggtaaccgggtaagggtaaccgtacggtaccgggtacccgtaacccggttccgacccgttaccgaccgtccccgtaaccccgaaccccggaaaccggggtccccctaacgggttccccggtttcccccgtttcccccggtaccgggtccccttaccccccgttcccgttaacccgaaccggacccggtccctacccggtaccggggttacccggggggtaaccttaacccgggaaccccggggg

SEQ ID NO: 434186 - DNA, 678 bp, Homo sapiens
  misc_feature: GZ8MTXP01A545F.9.63.F08.1.454.CMB.2.raw
  modified_base (189)..(189): a, c, t, g, unknown or other
  modified_base (246)..(246): a, c, t, g, unknown or other
  modified_base (448)..(448): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctcagtgcaagtctcctgccaggcctctggatatacataccgcgaccactacatacagtggtncgcctggcccctggacgaggccttgagtggctggctggatcaaccctacaccggtcnccaactatgcagcgtctttcggaactggtcacccgtgaccgtgggaccgcgtcccgacaactacacgtccctccaagtggaacttcgaacctacgtactagtaaacctctagaccgaccgaccggtaccgtactaactagttggtcggacggtagggtactaaagtacgtacttaaccaagtaaaccggtcgaccccggtanagtattagttagtttttcggagttcggtacgttacggggacgtaaaggtaccgacgccggttacgacccggtcccgccgtaccgaccgtaccccgtacccgaaccggaccggtaacccgtacgttcccggttaccccgttcccccgtaccggtaccccttaccccgttcccgttacccgaaccgtccgtaacccgtaccgtcggggaccgggtaaccgaaccggtccggg

SEQ ID NO: 434187 - DNA, 747 bp, Homo sapiens
  misc_feature: GZ8MTXP01CKV78.9.63.F08.1.454.CMB.2.raw
  modified_base (189)..(189): a, c, t, g, unknown or other
  modified_base (207)..(207): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctcagtgcaagtctcctgccaggcctctggatatacataccgcgaccactacatacagtggtncgcctggcccctggacgnggccttgagtggctgggctggactccaacccttacaccggtccgacccaaactatgcagcgttctttcggaactacgggtcaccctgacccgtgggaccgccgtccccgacaactaccacgccctccagttaggaacttcgaccaacactagaaactcgtagaccgacgacccgggtcccttacctaacgtagtttggtcgggacggtaggggtacctaaagttacgttacctttaaccgtaacgttaaaccgggtcggacccgggacacgtagttaggttagttttttgggacgttcgggttaccggttacgggggtaccgtaaaggggttaccgacgggtccgggtaccgtaccccggtccgacccgttcgaccggtccccgtacccgaaccccgtaaccggggaacccctaacgttcccgggtttccccgttccccccggttaccgggtccccttaacccccgttccccgttaccccgaacggtacccgtcccgtaccccgttccgggttaccgggggtccccgaacggccccgggg

SEQ ID NO: 434188 - DNA, 675 bp, Homo sapiens
  misc_feature: GZ8MTXP01CYT00.9.63.F08.1.454.CMB.2.raw
  modified_base (462)..(462): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctcagtgcaagtctcctgccaggcctctggatatacataccgcgaccactacatacagtggtgcgcctggcccctggacgaggccttgagtggctgggctggactccaacccttacgacccggtccgacccaaactatgcagcgttctttcggaacagggtccaccccgtggacctggggaccgccgtccccgacaactaccagcccctaccatggaactttcgaacccacactagaaactccgtagaccgtacaccggtacccgtactaactatttcgggtgcgggtagggtactaaagttacgtaccttaacaagtaaacgggtcgacccgganagtatagttatttttggattggtcgtggggaccgtaaggtacgacggtccggtcgacccgtcgccctacgccgccctaccccgaaccggtaccgggcccctacgttcccgggttccccttcccccgtcggtccccaccccgtttccccgaccccgaacggacccgtcccgaaccccggttccgggttacgggggccccgaacggccccggggg

SEQ ID NO: 434189 - DNA, 663 bp, Homo sapiens
  misc_feature: GZ8MTXP01DRLL4.9.63.F08.1.454.CMB.2.raw
  modified_base (267)..(267): a, c, t, g, unknown or other
  modified_base (308)..(308): a, c, t, g, unknown or other
  modified_base (317)..(317): a, c, t, g, unknown or other
  modified_base (398)..(398): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctgggcctcagtgcaagtctcctgccaggcctctggatatacataccgcgaccactacatacgagtgggtgccgccgtcggcccctggacgaggtccttgagtggcgtgggctggactaccaacccttacgacccggtcgaccaactngcagcgttcttacggaacgaggtccacctgacgtcggaccncgtcccganactacgcgcctcgagtcggtaactcgaaccacactagaaacctcgtagaccgacgaccgtacccgtactaacgtattcggngtacggtaacgggtacaagttacgtaccgttaacgaacggtaaaccgggtcgaccggtactaggtattagttagttttgagttggtacgtggggactaaggttacgacgtccggtacgtcccgtcgaccgtacaccgtcccgtacccgaaccgccggtccctacgttccccggttcccttacccccgttcggaccccttacccgttcccgttaccgaacgtaccgccgtacccggtccgggttacggggaaccaacggtcccggg

SEQ ID NO: 434190 - DNA, 661 bp, Homo sapiens
  misc_feature: GZ8MTXP01DF3X6.9.63.F08.1.454.CMB.2.raw
  modified_base (129)..(129): a, c, t, g, unknown or other
  modified_base (153)..(153): a, c, t, g, unknown or other
  modified_base (213)..(213): a, c, t, g, unknown or other
  modified_base (308)..(308): a, c, t, g, unknown or other
  modified_base (377)..(377): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctnagtgcaagtctcctgccaggcctntggatatacataccgcaccactacatacagtggtgcgcctggcccctggacgaggcttgngtggctgggctggatccaacccttagaccggtcgaccaaactatgcagcgttctttacggacagggtccaccctggacctgggacgcgtcccganaactacgagccctcagttagaacttcgaccaacactagaaactctagacgacgacgccgtatctattgngacgagggtacaagtacgtaccttacgaacgttaaacgggtcgacccggagtaagtagttaggttagtttttgggacgttgggttacgtacgggggtacgtaaacgggttacgacgggtaccggtccgaccccgttcggcccctacgaccgtccctacccgaacccgaacggggtcccctaacggttcccgttccccgttcccccgtcggaccccttaccccgttccttacccgaagtaccgaacccgtacccggtcggttccgggggaaccaaccggcccggg

SEQ ID NO: 434191 - DNA, 420 bp, Homo sapiens
  misc_feature: GZ8MTXP02JLVUN.9.63.F08.1.454.CMB.2.raw
  modified_base (387)..(387): a, c, t, g, unknown or other
  modified_base (416)..(420): a, c, t, g, unknown or other
tcagtgatacgtctcacgaccggtgctcgatttagcgatcgtataagggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacagcggccctggggctgcctggtcaaggctacttccagacgtntcactgagcgggctggcaaggcgcatagnnnnn

SEQ ID NO: 434192 - DNA, 421 bp, Homo sapiens
  misc_feature: GZ8MTXP02HQG9B.9.63.F08.1.454.CMB.2.raw
  modified_base (385)..(385): a, c, t, g, unknown or other
  modified_base (410)..(410): a, c, t, g, unknown or other
  modified_base (417)..(421): a, c, t, g, unknown or other
tcagtgatacgtctcacgaccggtgctcgatttagcgatcgtataagggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacagcggccctgggctgcctggtcaaggctacttcagacgtntcactgagcgggctgggcaagggcncgatagnnnnn

SEQ ID NO: 434193 - DNA, 549 bp, Homo sapiens
  misc_feature: GZ8MTXP02FU379.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctgggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacgcgtcccgcaatacagcctccatggaattgaccacactgaaactctgacgacacggccgtctctattgtgcgagggtcaaatagtcttaccataaacggtgacccggacagatgtatttttgatgtctgggccaaggtacagcggtcaccgtcgcctcacgcctaccaccgaacggcccacgtccggtccttcccccgtcggcccacccgtccctaccaacgcgaccaccctccgtcgggggccaacgccgg

SEQ ID NO: 434194 - DNA, 547 bp, Homo sapiens
  misc_feature: GZ8MTXP02J1G4W.9.63.F08.1.454.CMB.2.raw
  modified_base (300)..(300): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacacccggtcgcccaaactatgcagcgtctttcggaacagggtcaccctgacctgggacncgtcccgcaatacagcctccatggaattgaccacactgaaactctgacgacacggccgtctctattcgtgcgaggggtcaagtacgtcttaccataaacggtgcccggacagatgtatttttggatgtcgtggggccaaggtcaggcggtcaccgtcgcctcacgcctccaccgaacggcccagtccggtccttccccctggcccaccctccctaccaacgacgccacctcgtcggggcacgaccgg

SEQ ID NO: 434195 - DNA, 536 bp, Homo sapiens
  misc_feature: GZ8MTXP02G70BZ.9.63.F08.1.454.CMB.2.raw
  modified_base (278)..(278): a, c, t, g, unknown or other
  modified_base (297)..(297): a, c, t, g, unknown or other
  modified_base (365)..(365): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacnggtcacctgacctgggacncgtcccgcaatacagcctcatggaattgaccacactgaaactctgacgacacggccgtctactattgngcgagggtcaatgtcttaccataaacggtgcccggacagatgtatttttggattgtcgtggggccaaggtacgaggcggtcaccgtcgcctcacgcctccaccacggcccagtcgtccttccccgcggccaccctcctccaacgcgaccacctcgtcgggggccacgacgg

SEQ ID NO: 434196 - DNA, 552 bp, Homo sapiens
  misc_feature: GZ8MTXP02HFZJZ.9.63.F08.1.454.CMB.2.raw
  modified_base (436)..(436): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacaggtcacctgacctgggacgcgtcccgcaatacagcctccatggaattgaccacactgaaactctagacgacacggccgtctactattgtgcgagggtcaatagtacttacataaacgtcgaccgacagatgtattttgatgtcgtgggccaaggtacnggcgtcgaccgtcgcctcgacgccctccaccgaacgggcccacgtccggtcccttcccccgtcggccctacccctccctaccaacgacgccaccgtccgtcgggggccacgaccgg

SEQ ID NO: 434197 - DNA, 544 bp, Homo sapiens
  misc_feature: GZ8MTXP02GE9J2.9.63.F08.1.454.CMB.2.raw
  modified_base (300)..(300): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaaactatgcagcgtctttcggaacagggtcaccctgacctgggacncgtcccgcaatacagcctccatggaattgaccacactgaaactctagacgacacggccgtctactattgtgcgagggtcaaatagtcttaccataaacggtgcccggacagatgtattttgatgtctggggccaaggtacagcggtcaccgtcgcctcacgcctccaccgaacggcccacgtccggtcccttcccccgtcggccaccctccctccaacgacgccacctcgtcggggcacgacgg

SEQ ID NO: 434198 - DNA, 537 bp, Homo sapiens
  misc_feature: GZ8MTXP02GEXSJ.9.63.F08.1.454.CMB.2.raw
  modified_base (403)..(403): a, c, t, g, unknown or other
  modified_base (422)..(422): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacgcgtcccgcaatacagcctcatggaattgaccacactgaaatctgacgacacggcctctactattgtgcgagggtcaatagtcttacataaacggtgacccgganagatgtatttttggatgtntggggcaaggtacagcggtcacccgtcgcctcacgcctccaccaacgggcccactccggtccttccccctcggcccaccctccctccaacgacgcacctcgtcggggcacgacgg

SEQ ID NO: 434199 - DNA, 546 bp, Homo sapiens
  misc_feature: GZ8MTXP02H4KBA.9.63.F08.1.454.CMB.2.raw
  modified_base (191)..(191): a, c, t, g, unknown or other
  modified_base (424)..(424): a, c, t, g, unknown or other
  modified_base (494)..(494): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtncgcctggcccctggacgaggccttgagtggctgggctggatcaacccttacaccggtcgcccaaactatgcagcgtctttcggaacaggtcaccctgacctgggaccgcgtcccgcaatacagcctccatggaattgaaccacactgaaactctgacgacacggccgtctactattgtgcgaggtcaaatgtacttacagtaaacgtgacccggacagatgtattttgatgtntgggaccaaggtacagcgtcacgtcgcctcgagccctcaccgaacgggccacgtccggtccttcccccgnggtccccaccctcctccaaagcgaccacccgttcgacggggacaccgacggg

SEQ ID NO: 434200 - DNA, 575 bp, Homo sapiens
  misc_feature: GZ8MTXP02G6SIW.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggactcaacccttacaccggtcgcccaaactatgcagcgttctttcggaacagggtccaccctgaccgtgggacgccgtcccgcaatacagcctccatggaattcgaccacactgaaactctagacgacacggccgtctactattgtgcgagggtcaatacgtactacataaacggtcgacccggacagatgttattttgattgtcgtgggaccaaggtacaggcgggtcaccggtcgcctcgacgccctaccgaccgacgggcccacgtccggtcccttcccccgtcggccctacccctcctacccgaacgacgccgtaccgtcggtacgggggaccacggaccgg

SEQ ID NO: 434201 - DNA, 590 bp, Homo sapiens
  misc_feature: GZ8MTXP02IBEY4.9.63.F08.1.454.CMB.2.raw
  modified_base (278)..(278): a, c, t, g, unknown or other
  modified_base (313)..(313): a, c, t, g, unknown or other
  modified_base (487)..(487): a, c, t, g, unknown or other
  modified_base (558)..(558): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacngggtcaccctgacctgggacgcgtcccgcaatacngcctccatggaattcgaccacactgaaactctagacgacacggtccgtactactattgtggccgtaggggtcaaattagtcctttaaccaagtaaacggtcgaccccggactagattagttatttttggattgtcgtggggaccaagggttacaggtcggtcaccgtcgcctcncgcctccgaccgaacgggcccagttccggtcctttcccccgcggccctaccccgtcctacccgaacggacncccgtaccgtccgtcgggggaccacgaccggg

SEQ ID NO: 434202 - DNA, 549 bp, Homo sapiens
  misc_feature: GZ8MTXP02JWSXI.9.63.F08.1.454.CMB.2.raw
  modified_base (402)..(402): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacgcgtcccgcaatcagcctccatggaattgaccacactgaaatctgacgacacggcctctctattgtgcgagggtcaatagtcttaccataaacggtgcccgganagatgtatttttgatgtctggggccaaggtacagcggtcaccgtccgcctcacgccctccaccgaacggccccatccggtccttaccccctcggcccaccccgtccctaccaacgacgcctacccgtccgtcgggggccacgaccgg

SEQ ID NO: 434203 - DNA, 420 bp, Homo sapiens
  misc_feature: GZ8MTXP02HR8GH.9.63.F08.1.454.CMB.2.raw
  modified_base (388)..(388): a, c, t, g, unknown or other
  modified_base (418)..(420): a, c, t, g, unknown or other
tcagtgatacgtctcacgaccggtgctcgatttagcgatcgtataagggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaaagggcccatcggtcttccccctggcaccctcctccaagagcacctctgggggcacagcggccctggggctgcctggtcaaggctacttccagacgtntcactgagcgggctgggcaaggcgcatagnnn

SEQ ID NO: 434204 - DNA, 548 bp, Homo sapiens
  misc_feature: GZ8MTXP02J1WHN.9.63.F08.1.454.CMB.2.raw
  modified_base (299)..(299): a, c, t, g, unknown or other
  modified_base (362)..(362): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacncgtcccgcaatacagcctccatggaattgaccacactagaaactctgacgacacggcccgtcnctatgtgcgagggtcaagtcgtcttaccataaacggtgcccgacagatgtattttgatgtcgtgggccaaggtcagcggtcaccgtcgcctcgcgccctaccaccgacggccccagtccggtccttcccccgtcggcccaccctccctaccaacgtcgaccaccgtcgtcgggggccacgaccggg

SEQ ID NO: 434205 - DNA, 562 bp, Homo sapiens
  misc_feature: GZ8MTXP02JIICV.9.63.F08.1.454.CMB.2.raw
  modified_base (280)..(280): a, c, t, g, unknown or other
  modified_base (300)..(300): a, c, t, g, unknown or other
  modified_base (407)..(407): a, c, t, g, unknown or other
  modified_base (463)..(463): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgccccaaactatgcagcgttctttcggaacnggtcaccctgacctgggacncgtcccgcaatacagcctccatggattcgaccacactgaaactctagacgacacggccgtctactattgtgcgagggtcaaatacgtcttacataaacgtgccgganagatgtattttgattgtcgtgggccaaggtacgaggcggtcaccgtcgcctcgacnccctaccaccgaacgggtcccacgtcccggtcccttcccccgtcggcccaccccttcccgtaccaaacgccgccaccgtcgtcgggggccaccgccggg

SEQ ID NO: 434206 - DNA, 584 bp, Homo sapiens
  misc_feature: GZ8MTXP02JRDJT.9.63.F08.1.454.CMB.2.raw
  modified_base (260)..(260): a, c, t, g, unknown or other
  modified_base (301)..(301): a, c, t, g, unknown or other
  modified_base (309)..(309): a, c, t, g, unknown or other
  modified_base (334)..(334): a, c, t, g, unknown or other
  modified_base (410)..(410): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgacccaaatangcagcgttctttcggaacaggtcaccctgaccctgggaccncgtcccgnaatacagcctcatggaattgaccanactgaaactctagacgacacggccgtctactattgtgcgagggtcaaatcgtactacataaacgtcgacccggaanagtatgttagttttgagttgtcgtgggacgaaggtacgaggtcggtaccgaccgtcgcctcgacgtccctaccgaccgaaccggcctacgttcccgtcccttcccccgtcgacccctaccccgtacccacccgaacgaccgaccgtaccgtccggtacggggaccacggaccgg

SEQ ID NO: 434207 - DNA, 559 bp, Homo sapiens
  misc_feature: GZ8MTXP02IZ58L.9.63.F08.1.454.CMB.2.raw
  modified_base (451)..(451): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaaactatgcagcgtctttcggaacagggtcaccctgacctgggacgcgtcccgcaatacagcctccatggaattgaccacactagaaactctagacgacacggccgtactactattgtgcgagggtacaaatacgtacttaacataaacggtcgacccggacagtatgtagtttttgatgtcgtgggaccaaggtanaggcggtacaccgtcgcctcacgcctaccaacgaacgggcccacgtccggtccttcccccgtcgcccaccctccctaccaacgcgcacctcggcggggcacgaccggg

SEQ ID NO: 434208 - DNA, 534 bp, Homo sapiens
  misc_feature: GZ8MTXP02I2QAE.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctgggacgcgtcccgcaatacagcctccatggaattgaccacactgaaactctgacgacacggcccgttctactattgtgcgaggggtcaaatagtctacataaacgtgcccggacagatgtattttggatgtcgtgggccaaggtacagcggtcaccgtcgcctcacgcctacaccgaacggcccagtccgtcttcccctaggccaccctctaccaagcgccacctcgtcggggcacgacgg

SEQ ID NO: 434209 - DNA, 703 bp, Homo sapiens
  misc_feature: GZ8MTXP02JQRBP.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctgggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcaccctgacctggacgcgtcccgcaatacagcctccatggaattgaaccacactgaaactctgacgacgacggccgtactaccgtattcggtgtaccgagggggtaccaaagttacggtacctttaacccgaagttaaaaccgggtcgacccggtaaccagatgtaagttttttggagttgtacgtgggggtaccaagggttacgacggcgggtaccgtaaccggtccggcccttccgacggtccccttaccccgaacccgtaaccgggggaccccctaacggttccccgggttacccctttaccccccggttccgggaccccgtacccccccgttaccccttacccccggtaaaccggtaaccgccccgtaaaccccgttcccggtttacccggggggacccctaaccgaacccccggggg

SEQ ID NO: 434210 - DNA, 726 bp, Homo sapiens
  misc_feature: GZ8MTXP02IFT7G.9.63.F08.1.454.CMB.2.raw
  modified_base (269)..(269): a, c, t, g, unknown or other
  modified_base (316)..(316): a, c, t, g, unknown or other
  modified_base (394)..(394): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacaggtgggtgcgcctcggccccgtggacgaggtccttggagtggctgggctggactcaacccttacgaccggtccgacccaaaactntgcagtcgtctttcggaacagggtccacccgttgaccggtgggaccnccgtccgactaactacacgcctacagtagtatcgaaccactagtagtactcgtacgacgacgccggtccttctacgtnttggcgacgtaggtataatcgttaccttaacgaacgttaacgtcggacccgaagtacgtagttagtttagttttgagttcggtgggtaccggtaacgaacgggttacgcggtacccgggtacgtacccggtcgtaccctacggtacccgtacccgtacccgaaacccggggaaccccggtacccgttaaccgggttcccccggtttacccccttttacccccccgggacggtccccccttaacccccgttccccttaaaacccggaacgaaccccgtccgttaaaccccgggttacgggggccccggggtaacgaaacccgggtccccgggg

SEQ ID NO: 434211 - DNA, 628 bp, Homo sapiens
  misc_feature: GZ8MTXP02F2PJV.9.63.F08.1.454.CMB.2.raw
  modified_base (263)..(263): a, c, t, g, unknown or other
  modified_base (306)..(306): a, c, t, g, unknown or other
  modified_base (314)..(314): a, c, t, g, unknown or other
  modified_base (340)..(340): a, c, t, g, unknown or other
  modified_base (351)..(351): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacaggtgggtgcgcctggcccctggacgaggccttgagtggctgggctggatccaacccttacacccggtcgcccaaaactntgcagcgttctttcggaacagggtccaccctgacctgggaccncgtcccgnaatacagcctccatggaattgaccanactgaaactcngacgacacggccgtactctattgtgaccgagggtacaaagtacgtacttaacctaataaaccggtcgaccccggaatagtagttagttagttttttaggattggttacggtacgggggaccgtaaagggtacgacggtcgggtccgtacccggtccgacctcgacgcccctacccaacccgaacgggcccaacgttcccggttccccttcccccgtcggtcccctaccccttcccaccgaacgacgccacccgtccgtacgggggccacgacccggg

SEQ ID NO: 434212 - DNA, 573 bp, Homo sapiens
  misc_feature: GZ8MTXP02HT86L.9.63.F08.1.454.CMB.2.raw
  modified_base (373)..(373): a, c, t, g, unknown or other
  modified_base (444)..(444): a, c, t, g, unknown or other
  modified_base (531)..(531): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtctttcggaacagggtcacccctgacctgggaccgccgtcccgcaactacagcctccatggaattcgactacactagaactctagacgacacggccgtctctattgngcgaggtcaatacgtcttaacataaacgtgacccgacagatgtattttgatgtcgttggggcctaaggtanacgtcggtccaccgtcgcctcgacgtcccaccaccgaacggcccacgtcccgggtcccttcccccgttcggaccctaccccttcccnccaaacggccgaccgacccttcggcgggggacaccgtccggg

SEQ ID NO: 434213 - DNA, 551 bp, Homo sapiens
  misc_feature: GZ8MTXP02IN961.9.63.F08.1.454.CMB.2.raw
  modified_base (301)..(301): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaaactatgcagcgtctttcggaacagggtccaccctgacctgggacncgtcccgcaatacacgcctccatggaacttgaccacactgaaactctgacgacacggccgtctactatgtgcgagggtcaatagtctacataaacgtgccgacagatgtagtttttgatgtcgtgggactaaggtacagcggtcaccgtcgctcacgcctaccacaacggccacgtccggtcccttcccccgtcggcctaacccctcctacccgaacgacgaccacccgtcgacgggggccacgaccggg

SEQ ID NO: 434214 - DNA, 675 bp, Homo sapiens
  misc_feature: GZ8MTXP02H3TI7.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttcgaccggtcacccaaactatgcagtcgttcgttttcggaactagggtccacccgtgaccgtgggaccgccgtcccgacaaactaccacgccctccagtcggaattcgacctacactagaaactctacgacgacacggccgttactactattgcgtacgagggtacaattacgtacttacgaagtaacggtcgacccggactagtattgttagtttttggagttgtacggtggggtaccaacgggttacgacgggtccggtaccgtacccggttccgccgttacgaccgtaccccgtacccgaaaccgaaacccggggcccctacggtttcccgggttcccctttaccccccggttcggcccctaacccccgttcccttacccgaaaacgccggtacctaacccggttcggtccgggggacaacccggtcccgggg

SEQ ID NO: 434215 - DNA, 597 bp, Homo sapiens
  misc_feature: GZ8MTXP02J17DK.9.63.F08.1.454.CMB.2.raw
  modified_base (191)..(191): a, c, t, g, unknown or other
  modified_base (364)..(364): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtncgcctggcccctggacgaggccttgagtggctgggctggatccaacccttacgaccggtccgacccaaactatgcagcgtctttcggaacagggtcaccctgaccgtgggaccgcgtcccgcaactacacgcctccatcggaattcgaccacactagaaactctagacgtacncggcctactctattgtgacgagggtcaaagtcgtactaaccaagtaacggtcgacccgacagtatgttagttttggattgtacgtgggaccaaggtacaggtccggtacgaccgtccgcctcgacgtccctccgacccgtaacgggcccctacgtcccggtcccttcccccgtcggacccctacccctcccacccgaacgcgcctacccgtcggtcggggaccacggacccgg

SEQ ID NO: 434216 - DNA, 616 bp, Homo sapiens
  misc_feature: GZ8MTXP02JYQOB.9.63.F08.1.454.CMB.2.raw
  modified_base (406)..(406): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggccttgagtggctgggctggactccaacccttacgacccggtccgaccccaaaactatcgcagcgttctttacggaacgacgggtccaccccgtgaccgtcgggacgccgtccccgacaactaccgacgccctccgatacggtaacttcgaccacactagaaactcgtagacgaacacggccgttactactattggngcgagggtcaaatgtacctacgataaacggtcgacccgagagatgttagttttgattgtcgtggggaccaaggtacaggtccggtactacccgtcgcctcgacgcctaccgaccgaacggccctagtcccggttcccttccccgtcggtcccctaccccgtcctacccgaacgaccgacctacccgtcggtccggggaccacgacccggg

SEQ ID NO: 434217 - DNA, 594 bp, Homo sapiens
  misc_feature: GZ8MTXP02H4WU2.9.63.F08.1.454.CMB.2.raw
  modified_base (190)..(190): a, c, t, g, unknown or other
  modified_base (315)..(315): a, c, t, g, unknown or other
  modified_base (344)..(344): a, c, t, g, unknown or other
  modified_base (386)..(386): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggctcagtgcaagtctcctgccaggcctctggatatacataccgcgaccactacatacagtgggtncgcctggcccctggacgaggccttgagtggctgggctggatcaacccttacgacccggtcgacccaaactatgcagcgtctttacggaacacgggtcaccgtgacccgtgggaccgccgtcccgnaactacacgccctcatggaattgaaccanactagaaactctagaccgacgacggccgttactactagttgngacggtaagggtcaaattacgtaccttaaccgaagtaaaccggtcgacccggaacagtattgttagtttttggattggtcgtggggacctaaaggttacgaggcggtacgaccgtccgcctcgacgccctacgaccgaacgggccacgtccggtcctccccgcgcccaccctcctaccaacgcgccaccgtcgacggggacacgacgg

SEQ ID NO: 434218 - DNA, 570 bp, Homo sapiens
  misc_feature: GZ8MTXP02GWUI8.9.63.F08.1.454.CMB.2.raw
  modified_base (258)..(258): a, c, t, g, unknown or other
  modified_base (308)..(308): a, c, t, g, unknown or other
  modified_base (373)..(373): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgctggcccctggacgaggccttgagtggctgggctggatcaacccttacaccggtcgcccaaactntgcagcgtctttcggaacagggtcacccgtgacctgggaccgcgtcccgnaatacagcctccatggaattgacctacactgaaaactcagacgacgacggccgtctactattggngcgagggtcaatcgtactaccagtaaacgtcgacccgacagactgtattttggattgtcgtgggcaaggtacgagcggtcaccgcgcctcgacgcctaccgacgaacgggccctacgtcccggtacccttccccgttcgggaccctaccccgtccctacccgaacgcgtaccaccgtcgtcggggaccacgacccgg

SEQ ID NO: 434219 - DNA, 547 bp, Homo sapiens
  misc_feature: GZ8MTXP02F1RRR.9.63.F08.1.454.CMB.2.raw
  modified_base (261)..(261): a, c, t, g, unknown or other
  modified_base (280)..(280): a, c, t, g, unknown or other
  modified_base (301)..(301): a, c, t, g, unknown or other
  modified_base (309)..(309): a, c, t, g, unknown or other
  modified_base (335)..(335): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacacccggtcgccccaaaatntgcagcgtctttcggaacnggtcaccctgaccgtgggacncgtcccgnaatccagcctccatggaattgaccanactgaaactctagacgacgacggacctctactatgtagcgaggtacaaatcgtactacaagtaaacggtcgacccgacagatgtattttgactgtcgtgggaccaggtacagcggtcaccgtcgctcacgcctaccacgacgccacgtccggtcctccccgtcgcccaccctcctaccaagccgaccaccgtcgtacggggccacggaccgg

SEQ ID NO: 434220 - DNA, 693 bp, Homo sapiens
  misc_feature: GZ8MTXP02HB86O.9.63.F08.1.454.CMB.2.raw
  modified_base (284)..(284): a, c, t, g, unknown or other
  modified_base (314)..(314): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggactcaacccttacgacccggtcgacccaaactatgcagtcgttctttcggaacnggtccacctgaccgtgggacgcgtcccganaactacagcctcatggaatcgaccacactagaactcagacgacacggtccgtactactacgttgcggacgtaggggttactaaagttacgttaccttaacctaaacgttaaacggtcggacccggaacgtagtagttagttagttttttaggagtttcggttacggtacgggggtaccgtaaacgggttaacgacggaccgggttaccgtaacccggtaccgtcccgttacgaaccgtccccgttacccgaacccgaaacccggggtacccctaacggttccccggtccccgtttcccccgccgggtacccctacccccgtacccgttaaccgaacgaccgaccgtacccgtacggtccggggaccgacgtacccgggg

SEQ ID NO: 434221 - DNA, 542 bp, Homo sapiens
  misc_feature: GZ8MTXP02JVOTT.9.63.F08.1.454.CMB.2.raw
  modified_base (264)..(264): a, c, t, g, unknown or other
  modified_base (307)..(307): a, c, t, g, unknown or other
  modified_base (314)..(314): a, c, t, g, unknown or other
  modified_base (338)..(338): a, c, t, g, unknown or other
  modified_base (354)..(354): a, c, t, g, unknown or other
  modified_base (366)..(366): a, c, t, g, unknown or other
  modified_base (370)..(370): a, c, t, g, unknown or other
  modified_base (410)..(410): a, c, t, g, unknown or other
  modified_base (469)..(469): a, c, t, g, unknown or other
  modified_base (510)..(510): a, c, t, g, unknown or other
  modified_base (538)..(538): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggactccaacccttacgaccggtccgcccaaaactntgcagtcgtctttcggaactggtccaccgtgaccgtgggaccncgtccgnaatcacgcctcatggatcgaccanactgaactcagacacncggcctctactnttgngcgaggtacaatcgtactacgaataaacggtcgacccganagtatgttagttttagattgtcggtgggacaggtacaggcggtacacgtcgcctacgcnccctacgaccgacggcccagtccgtcccttccctcggcccncccgtcacgaagctccactcgacggacncgcg

SEQ ID NO: 434222 - DNA, 779 bp, Homo sapiens
  misc_feature: GZ8MTXP02GTIK5.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggtccttgagtggctgggctggactccaacccttacgaccggtcgacccaaactagtcgcagtcgtcgttttacggaactacgggtccaccccgtggaccgtggggaccgccgtcccgacaacgtacacggccctaccgagttacgggaattacgaaccctaacacgttagaaaacctctacggacgtaccgaccgggtacccttacgtacttacgttaggtcggaccgggtaggggttacaaacgttacgttaccttaaccgtaaacggtaaaccgggttccggacccgggaactaaggttacgttacgtttaagttttttacgggagttcgtttacgggtacgggggtaccgtaaacgggtacgtacgggtacccgggtaccgtaaccccggttccggacccttaccggaccgtaccccgttacccgaaacccggaacccggggtaccctaaccggttcccgggtttacccccgttcccccggaccggtacccctacccccgtacccgtacccgtaaacggaccgacccgtaaccccggtcggggtaccggggcccaacggtacccggg

SEQ ID NO: 434223 - DNA, 693 bp, Homo sapiens
  misc_feature: GZ8MTXP02HRKNK.9.63.F08.1.454.CMB.2.raw
  modified_base (302)..(302): a, c, t, g, unknown or other
  modified_base (364)..(364): a, c, t, g, unknown or other
  modified_base (373)..(373): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgacccaaactatgcagtcgtctttcggaacagggtcacccctgacctgggacncgtcccgacaatacagcctccatcggaattgaccacactagaaatcagacgacacggccctntactattgngccgagggtcaaattacgtactttaaacccaagtaaaacgggtacgaccccgggaaacgtaagtagttagtttaagtttttacggagttacggttacggtacggggtaaccgtaaacgggttacgacgggtaccgggtacccgtacccggtacccgtacccgtaccgtaccgtacccgtacccgaacccgaaacccggtacccgtaccgttacccggttaccccgttcccccgttacccgtacccgtaccccgttaccccgtacccgtaaaccgaccgtacccgtacccgtaccggtaccgggtaccgtaaccgtaccgg

SEQ ID NO: 434224 - DNA, 599 bp, Homo sapiens
  misc_feature: GZ8MTXP02IV7BO.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatccaacccttacaccggtcgacccaaactatgcagtcgtctttcggaacacggtccacccgtgacccgtgggaccgccgtcccgacaactaccgacgtcctaccagtcggaattcgaaccacactagaaactcgtagacgacgacggccgttactactattcgagccgaaggggtacaaattacgtaccttaaccgaacgtaaacggtcgacccggacgagtatgtagttttaggattgtacgtgggacaaggtacacgcgtacaccgtcgcctcgacgccctaccgaccgaacggacccacgtcccgtaccttccccgacgtccctaccctcctaccgaacgcgacgaccgtcgcggggcacgccgg

SEQ ID NO: 434225 - DNA, 533 bp, Homo sapiens
  misc_feature: GZ8MTXP02F4C9B.9.63.F08.1.454.CMB.2.raw
  modified_base (188)..(188): a, c, t, g, unknown or other
  modified_base (257)..(257): a, c, t, g, unknown or other
  modified_base (330)..(330): a, c, t, g, unknown or other
  modified_base (341)..(341): a, c, t, g, unknown or other
  modified_base (501)..(501): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctgggcctcagtgcaagtctcctgccaggcctctggatatacataccgcgaccactcatacagtggtncgcctggcccctggacgaggccttgagtggctgggctggatcaacccttcacccggtcgcccaaaactntgcagcgtctttcggaacagggtcacctgacctgggacgcgtcccgcaatacagcctccatggaattgaccanactgaaactcngacgacacggccgttctcctatgtgcgagggtcaaatagtcttaccataaacggtgacccggacagatgtatttttggatggtctggggtacaggtacagcgggtcaccgtcgcctcacgcctccacaacgggcccatccggtcctcccctcgccacccncctccaacgagccacgtcctcggggcacacgg

SEQ ID NO: 434226 - DNA, 747 bp, Homo sapiens
  misc_feature: GZ8MTXP02F2J1C.9.63.F08.1.454.CMB.2.raw
  modified_base (262)..(262): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacaggtggtgcgcctcggcccctggacgaggccttgagtggctgggctggactccaacccttacaccggtcgacccaaatntgcagtcgttctttacggaacacggtccacccgtgaccgtgggaccgccgtacccgactaacaccacgtccctaccgtaagtcggtaattccggaaacccacgaacttaacggaaaacctttcgacggaacgtaaccggtacccgggtacccttacttaccgttagttcgggtacggacggtaggggttaaccaaagtttacgttaaccgttaaccgtaaacgtaaaccgggtacggacccggtaacgtaagtagtttaggtttagttttttaggaagttcggttacgggtacggggtaccgtaacgggttaacgacggtaccgggtacctaaccccggttccgaccctacgaccgccccgtaaccgaaccccggtaacgggccctaccggttcccgttccccgttcccccggttacgacccctaccccgtccctaccgaaccgtaccgacccgtaccggtccggacggggaccacggacccggg

SEQ ID NO: 434227 - DNA, 803 bp, Homo sapiens
  misc_feature: GZ8MTXP02IYYHS.9.63.F08.1.454.CMB.2.raw
  modified_base (301)..(301): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggagcctggggcctcagtgcaagtctcctgccaggcctctggatatacataccgcgaccactacatacagtgggtgcgcctggcccctggacgaggccttgagtggctgggctggactccaacccttacaccggtcgcccaaactatgcagcgtctttcggaacagggtcaccctgaccgtgggacncgtccgcaatacagcctcatggaattcgacctacactagaaactcgtagacgaccgtacggcccgttactacgttagttcggtcggacggtaacgggggttacaaaagtttacgttacccgtttaaccgtaaacgttaaaaccggggttcggacccccgggtaacgtaaagtacgtttaggtttagtttttttagggaacgttcgggttacggttacgggggtaacccgtaaaggggttaaccgtacgggtaccgggtttaccgaacccggttcccggtacccgttaccgaaccggtcccccttacccgaaaaccccggaaaccgggggtaccccctaaacggtttcccccggggttaccccctttacccccccgggttacgggtccccccttaaaccccccgttcccccgtttaaccccgtaaaaccgggacccgtaccccggttaaccccggttccggggtttacccggggggtacccgtaaacccggtaaccccggggg

SEQ ID NO: 434228 - DNA, 756 bp, Homo sapiens
  misc_feature: GZ8MTXP02FZFCY.9.63.F08.1.454.CMB.2.raw
  modified_base (192)..(192): a, c, t, g, unknown or other
  modified_base (267)..(267): a, c, t, g, unknown or other
  modified_base (290)..(290): a, c, t, g, unknown or other
  modified_base (297)..(297): a, c, t, g, unknown or other
  modified_base (314)..(314): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacaggtgggtncgccgtggcccctggacgaggccttgagtggcgtgggctggactccaacccttacgacccggtcgaccccaaatntcgcagtcgttctttcggaacgngggtccnccgtgaccgtgggaccnccgtcccgacaatccacggtcctccgagtcggactttcgaacccatacctagaacctcgtagaccgacgccggtaccgttactcgttagttggacgtaccgtagggttactaaagttacgttaaccttaaccgtaaacgtaaaccgggttcggacccggaacgtaaggtaacgtttggtttaaacgttttttcgggaaagtttcggttaccgggttacgggggtaaacccgtaaaggggttaaccgacggggttcccgggtaaccgtaaccccggtccgtacccgttaccgtaaccgccccttaaccggaacccggaacccgggtacccctaaccggtcccggttaacccccgttcccccgtccggtaccccgtaccccttacccgtaaccgaacggtaccgacccgtacccggtcgggtaccggggcccaacggtcccggg

SEQ ID NO: 434229 - DNA, 766 bp, Homo sapiens
  misc_feature: GZ8MTXP02IS5UG.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacgagtgggtgcgccgtggcccctgggacgaggccttgagtggctggggctggactccaacccttacgaccggtccgacccaaactatgcagtcgttctttacggaacgtaggtccacctgaccgtgggaccgccgtcccgactaactacacgcctaccgtatacgggaacttcgaaccctaacgacgttacgaaaccttccgtacgaaccggaccgaccgggtcccttactacgttacgttaggtcggaccggtagggtacctaaagttacgttaccgttaaaccgaacgttaaaccgggtaccgggacccggaaacgagtacgttagtttagtttttagggagttcgggttacggtacggggtaccgtaaacgggttacgtacggtaccgggtacccgaccggttcccgcccgttaccgacccgtacccggttaccccgacccggaaccgggtaccccgtaccgttccccggttaccccgtttcccccgtcccggggtaccctacccccgttacccgtacccgtaaaccggacgacccgtacccggtaccggttcccgggggcccgtaaaccggccccggggg

SEQ ID NO: 434230 - DNA, 662 bp, Homo sapiens
  misc_feature: GZ8MTXP02JZMFS.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatccaacccttacaccggtcgacccaaactatgcagcgttctttcggaacaggtccacccgtgaccgtgggacgccgtcccgcaatacacgcctccatggaattcgaccacactagaaactctagaccgacacggccgttactctagttggtcgcgtagggtactaaagttacgtaccttaaccgaagtaaaacccgggtcggaccccggaagtacgtagttaggtttaacgtttttgggattcgggttacggtacgggggtaccgtaaagggtacgacggtccgggtaccgacccgtccgaccctccgaccgtccccgtacccgacccgaacggtcccctacgttcccggtacccttcccccgtcggtacccctacccccgtcccgtaccgaacgtaccgcctacccgttcgacggggtaccacggaccgg

SEQ ID NO: 434231 - DNA, 863 bp, Homo sapiens
  misc_feature: GZ8MTXP02GBVKQ.9.63.F08.1.454.CMB.2.raw
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtggtgcgcctggcccctggacgaggccttggagtggctgggctggactaccaacccttacgaccggtcacccaaactatgcagcgttcgtttacggaacgacggtccaccccgtggaacctggggaccgtccgtacccgactaactacccgacggtcccctaccgacgtaggtaacgtttaccggaaaccctaactaaccgttagtaaaaccctcgtacgaaccgtaccgaccggggtcccttaccggttacttaagtttcggtacggtaccggtaacgggggttacctaaaagtttacggttaaccctttaaacccggtaaacgtttaaaaacccggggtaccggtaacccccggggtaaacgtaacggttaaacgtttacggtttaagttttttttaccggggagtttaacggggttccgggtacgggggtaaacccgtaacggggttaaccgtacggggttaccggtaccgtaaaccccggttccgaccccgttacgaaccgtcccccgttaacccgaacccgaacccggggacccccgttaagttaccccggttccccgtttccccccgcgggtacccccgttaacccccgttaccccttaaccggaaaccgggttaacccccgtacccggtacccggttaccggggtaccggggtacccgacccggtaccggg

SEQ ID NO: 434232 - DNA, 783 bp, Homo sapiens
  misc_feature: GZ8MTXP02HOQ7A.9.63.F08.1.454.CMB.2.raw
  modified_base (153)..(153): a, c, t, g, unknown or other
tcagtgatacgtctcacgaccggtgctcgatttagcgatcgtataagggttgatccagcccagccacaggagcccactcccaggtgcagttgatgcatctgggcctgacgtgaggaagcctgggcctcagtgcaagtctcctgccaggccctntggatatacataccgcgaccactacatacaggtggtgccgcctcggcccctggacgacggtccttggagtggcgtgggctggactacccaacccgttacgacccggttcccgaccctaaactatcgacgtacgtccgttacgtttacggaaccgtacggtcccctacccgtcgtacccgtgggacccgtccgtccccgactaactaccgaccgtccctactagtacggtattaccgaccaacgtactaacgtaacgtccgtaacgaccgaaccgtaccgggtcccttacgtacctttaggtttacggacggtacgtaaggggttacctaaagtttaccgtttaccgttaaacccgtaaacggttaaaaccggtcccggaacccccggtaagttagtaaccgtttagtttttaggttttagtacgttcggtacggttaccggggtaaacctaagggttacgacggtacgtaccccgtaccgtcgtcccgtagaccccgtaccgtacccggaacccgtaacccgtccctaccggggtttcccctacccgttccccggtaaccgccccttaacccccctcgtaaacccgaagtcccgacccgtacgttccggaccgaccgtaacgcccccggg

SEQ ID NO: 434233 - DNA, 747 bp, Homo sapiens
  misc_feature: GZ8MTXP02G1UTR.9.63.F08.1.454.CMB.2.raw
  modified_base (266)..(266): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggactccaacccttacaccgggtaccaccctaaaactntcgcacgtccgttcgtttacggaactacgggtacccacccgtcgaaccggtcggggaaccgtcccggtaccccgactaacgtaccaggtcccctacagttacgggtaacttaccggaacctaacctaacgttagaaaaccgttccgtacgaaccgacgtaccggggtacccttacttacgttagtttcggacggtaccgacggggttacaaaagttaccggttaccttaacctaaacggttaaaccgggtccgaacccggtaagtagtacgttagtttagttttaggattcggtacgggtcgggaaccgtaacggttacgacggtccgggtaccgaccggtcgacccttacgaacccgtccacccgaacgaccggtccacccggttcctacccccgttccccaccggtacccctcccccgtaccgtacccgaacgttaccgaccgtacccgtcgggtccggggaacccacggtacccgggg

SEQ ID NO: 434234 - DNA, 569 bp, Homo sapiens
  misc_feature: GZ8MTXP02HSM9N.9.63.F08.1.454.CMB.2.raw
  modified_base (300)..(300): a, c, t, g, unknown or other
  modified_base (324)..(324): a, c, t, g, unknown or other
tcagtgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatccaaacccttacaccgggtcacccaaaactatgcagcgttccgtttcggaacagggtcaccctgaccngggtaccgcgtcccgcaatacgancccgtacagtacggaattgaacctacactaggaaactcgtgaacgaccacgtccgtacttactatgtgcgagggtacaaatcgtactaccaataaacgtgaccggactagatggtattttgatgtcgtggggcaaggtacgagtcggcaccgtcgctcacgcctaccgacgaacggtccagttacccggcttcccctcggacccacctcccgtacaacgacgctacgtacgcggggacacgacgg

SEQ ID NO: 434235 - DNA, 752 bp, Homo sapiens
  misc_feature: GZ8MTXP01C7NAX.2.11.A11.1.454.CMB.2.raw
  modified_base (227)..(227): a, c, t, g, unknown or other
  modified_base (248)..(248): a, c, t, g, unknown or other
  modified_base (302)..(302): a, c, t, g, unknown or other
tcagacgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgcttgttgtactgcctcctcccgnggtctttgtcttggctattancgccacctccacgccgtccacgtaccagttgaacttgacctcgagggtcttcgnggctcacgtcccaccaccacgcatcgtacgacccgtcggacgggggtcccggagtattccgaagtggtacggggtttccgttcccgggttttgggggttttcgggggcccgttcggggggtaccttacgggtcgggggacccgaaaggggaaaccctagttccgggtacctacccggttcctccctcgaaccgccccgtacccgaacccgtaacggggcccctacgttcccgggttcccctttccccccgacgggtcccctaacccccgttcccgtaacccgaaacggaccgtacccgtaacccgttccggtccgggggacccaaccgaccgggcccggtccccgtcggggtcctcggtcccgttacgggttaccgaaacgggttaccttaccgttcccgttcggttccgacggtccggtcgtcggacggtccgggctcgggcgaacggg

SEQ ID NO: 434236 - DNA, 608 bp, Homo sapiens
  misc_feature: GZ8MTXP01B50F3.2.11.A11.1.454.CMB.2.raw
  modified_base (222)..(222): a, c, t, g, unknown or other
  modified_base (239)..(239): a, c, t, g, unknown or other
  modified_base (407)..(407): a, c, t, g, unknown or other
  modified_base (468)..(468): a, c, t, g, unknown or other
tcagacgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgactgctctccgngtctttgcttgcattancgcacctccacgcctcacgtaccagttgaacttgacctcagggtcttcgtgctcacgtccaccaccacgcatcgtcgaccgtgacgggggtccggagatcgagtggaggtcgttccggttggggtttgggcccgtcgggggacttacggtggggacctacgggaaccngtcggtccaccgtctccctgacgccctacgaccgaacgggcccacgttccgtccttccccnggccctacccgtcctacgaacgacgccaccgtcggcggggccacgacggccgtcccgtgggctcggtccgtcggttcgaaacggttcctacgttccgttaggttcgacgcgtcgtaaggcggcgggctcgggcgtaacgg

SEQ ID NO: 434237 - DNA, 587 bp, Homo sapiens
  misc_feature: GZ8MTXP01C9EAV.2.11.A11.1.454.CMB.2.raw
  modified_base (193)..(193): a, c, t, g, unknown or other
  modified_base (223)..(223): a, c, t, g, unknown or other
  modified_base (400)..(400): a, c, t, g, unknown or other
  modified_base (557)..(557): a, c, t, g, unknown or other
  modified_base (568)..(568): a, c, t, g, unknown or other
tcagacgctcgacacacgaccggtgctcgatttagctacgactgcagggtgtacacctgtggttctcgggctgccctttggctttggagatggttttctcgatgggggctgggagggctttgttggagaccttgcacttgtactccttgccattcagccagtcctggtgcaggacggtgaggacgctgaccanacggtacgtgctgttgactgcctcctccgnggtcttttgcttggctattatcgcacctccacgccgtcacgtaccagtgaacttgacctcaggtctcgtgctcacgtccacaccagcatgtcgacctcgaggggtccggagatcagtgagggtcgtccgttggggtttgggcctacgggggctacggtcggggccaaggggaaaccngtcgggtacaccgtctcctcacggtcccacaaccgaacgggccctacgtccggtccccttccccgcggcccaacccttccgacccgaaagtacgccaccgtcgcggggcacgacgcgccgtcgggctgcctgggaccaaaggttcgtaaccttccgngttcgcgtcgngtcgcgcggctcggcgaag

SEQ ID NO: 434238 - DNA, 600 bp, Homo sapiens
  misc_feature: GZ8MTXP01A27Y8.2.11.A11.1.454.CMB.2.raw
  modified_base (224)..(224): a, c, t, g, unknown or other
  modified_base (244)..(244): a, c, t, g, unknown or other
  modified_base (301)..(301): a, c, t, g, unknown or other
  modified_base (432)..(432): a, c, t, g, unknown or other
  modified_base (490)..(490): a, c, t, g, unknown or other
  modified_base (538)..(538): a, c, t, g, unknown or other
tcagacgctcgacacacgaccggtgctcgatttagctacgactgcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgtgtactgctcctccgnggtctttgtcttgctattangccacctccacgcccgtacacgtaccagttcgaacttcgacctcgagggttcttcgnggctccaccgtcccaaccaccacgcatcgtacgaccgtcggagggggtcccggagactcgagtggtacggggttcgttccggtttggggtttcggggccgtcgggggactacggtggggaccacggggacngtcggtccacgtcctctcgacgccctaccgaaccgacggccacgttccgtcctccccngcccacctccaccgacgacgccaccgtcgtcggcacgcggccgtccgnggctcgcgtcgacgacgttcgtacgtcgttcgttcgcgtcgtgcgcggcggcgtcggcgaag

SEQ ID NO: 434239 - DNA, 714 bp, Homo sapiens
  misc_feature: GZ8MTXP02HP44Y.2.11.A11.1.454.CMB.2.raw
  modified_base (224)..(224): a, c, t, g, unknown or other
  modified_base (343)..(343): a, c, t, g, unknown or other
  modified_base (345)..(345): a, c, t, g, unknown or other
tcagacgctcgacacacgaccggtgctcgatttagctacgactgcagggtgtacacctgtggttctcggggctgccctttggctttggagatggttttctcgatgggggctgggagggctttgttggagaccttgcattgtactccttgccattcagccagtcctggtgcaggacggtgaggacgctgaccacacggtacgtgctgttgtactgcctcctccgnggtctttgtcttggcattatgcacctccacgccgtccacgtaccagttgaacttgacctcgaggtctcgtggctcaccgtccaccaccacgcatgtcgacctcggaaggggtccggganancagtgagggtcgtcgtttggggtttcggggccgtagggggtctacgggtcgggggaccgtaaggggaacctaggtcgggtaccaccggttccttcccgacgaccggtccctacccgaaccggaacggggacccctacgttcccgggttccccttacccccgtcggccctaacccccttcccgtaccgaaacggccgtaccgaccgtcggtcgggggaccaaccggtcggcccggggtccccggtagggtccctacggtccggttacgggtaccgtaaaccggtaccttaccgttcccggttacggtaccggtacggtcccggttacggtacgggacggggaccgggtccggtaccggacggtaaccggg

SEQ ID NO: 434240 - DNA, 648 bp, Homo sapiens
  misc_feature: GZ8MTXP02HGLN8.2.11.A11.1.454.CMB.2.raw
  modified_base (226)..(226): a, c, t, g, unknown or other
  modified_base (247)..(247): a, c, t, g, unknown or other
tcagacgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacgacggtacgtgctgttgtactgcctcctccgnggtctttgtcttggctattangccacctccacgccgtccacgtaccagttcgaacttgacctcgagggtcttcgtggctcaccgtccaccaccacgcatgtcgacctcggacggggtccggagactcgagtggaggttcgttccggtttggggtttcggggccgtcgggggctacggtcgggggccaagggaacctgtcggtccaccgttctccctcgacgtccctaccgaccgaacgggccctacgttcccggtcccttcccccgtcgccctaccccgtcctaccgaacgtacgcccaccgtcgtacggggccacgcggccggtcccgtcgggctcggtccgtaggtaccgtaaacggtaccttaccgttccgtacggtccgtacgtcgtcgtcggacggcgggtcgtacggacgtaacgg

SEQ ID NO: 434241 - DNA, 598 bp, Homo sapiens
  misc_feature: GZ8MTXP02HPB5B.2.11.A11.1.454.CMB.2.raw
  modified_base (274)..(274): a, c, t, g, unknown or other
  modified_base (310)..(310): a, c, t, g, unknown or other
  modified_base (385)..(385): a, c, t, g, unknown or other
  modified_base (397)..(397): a, c, t, g, unknown or other
  modified_base (408)..(408): a, c, t, g, unknown or other
  modified_base (413)..(413): a, c, t, g, unknown or other
  modified_base (447)..(447): a, c, t, g, unknown or other
tcagacgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctccgcggtctttgcttggctattatgcctacctccacgccgtccacgtaccagtnaactgacctcgaggtctcgtgctcacgtccaccacncgcatgtcgaccgtcgaggggtccggagatcagtggtaggtcgttccgttggggtttcgggcgtcggggctacgnggggccaggacngtcgcacgtcncgtcncgcctacacgacggcctagtccggtcctccccgngcctacccgtcctacaagtcaccaccgtgtcggggaccacgacggcccggtccgtggggtctcggccgtttacggaccgaaaccggtaccttaccgttccgtcggtaccgacgtcccggtagtcggacggtcggtcgtacggaccgacggg

SEQ ID NO: 434242 - DNA, 496 bp, Homo sapiens
  misc_feature: GZ8MTXP01CHP2I.39.38.D05.1.454.CMB.2.raw
  modified_base (496)..(496): a, c, t, g, unknown or other
tcagtcgcactagtcacgaccggtgctcgatttagtatctgatagttgggtttgggagtcagactcagtcaggacacagcatggacatgagggtcccgctcagctcctggggctcctgctgctctggctcccaggtgccaaatgtgacatccagatgacccagtctccttccaccctgtctgcatctgtaggagacagagtcaccatcacttgccgggccagtcagagtcttaatagctggttggcctggtatcagcagaaaccagggaaagcccctaagctcctggtctctggtgcctccagtttgcaaagtgggtcccatcaaggttcagcggcagtgaatctgggacagaattcactctcaccatcagcaacgtgcagcctggtgtatttgctaacttattactgccagcatattatacttaccttatacttttgcctaaggggaccaaggcttagagattacaaaagaactgtaggctgcacctaattcgtn

SEQ ID NO: 434243 - DNA, 503 bp, Homo sapiens
  misc_feature: GZ8MTXP01APWFH.39.38.D05.1.454.CMB.2.raw
  modified_base (272)..(272): a, c, t, g, unknown or other
  modified_base (477)..(477): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtcttaatagctggttggcctggatcagcagaaaccagggaancccctaagctcctggtctcgtggtcgcctccagttttgacaaaggtgggggtcccatcaacggttcagcggcagtgaatcgtgggacagaattcactctcacatcagcaacgtgcagcctggtgtatttgactaacttagtactgccagcactattactacttacctactactttgctaagggccagcttagacgattacgaaanacgtgtaggctgcacctaattcgtcg

SEQ ID NO: 434244 - DNA, 604 bp, Homo sapiens
  misc_feature: GZ8MTXP01C2IYU.39.38.D05.1.454.CMB.2.raw
  modified_base (239)..(239): a, c, t, g, unknown or other
  modified_base (282)..(282): a, c, t, g, unknown or other
  modified_base (310)..(310): a, c, t, g, unknown or other
  modified_base (359)..(359): a, c, t, g, unknown or other
  modified_base (370)..(370): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacgttgccggcagtcagagtacttaanagcgtggttcgcctggtactccgacaagaaaccgagggaaacncccctaagcctccgtggtctcgtggtcncctcgtagtttgacgaaaggtcgggtacccagtcgaaggttccaggcgnagtgaaatcgngggacaagtaacttcactctacaccatcacgacaacgtgcgagtccgtggtagttatttacgacttaactttaacttacggtacgtacctacgtactaacttaacttacttaaccttttaacccttacgttacgttttacggaccgtaacggggaacctaagttacgtaagacgtaaactaacgttaaaagttcgttaggtcgacgtcgacctacttacttcgttcgtttaacc

SEQ ID NO: 434245 - DNA, 567 bp, Homo sapiens
  misc_feature: GZ8MTXP01C5QVH.39.38.D05.1.454.CMB.2.raw
  modified_base (221)..(221): a, c, t, g, unknown or other
  modified_base (364)..(364): a, c, t, g, unknown or other
tcagtcgcactagtcacgaccggtgctcgatttagtatctgatagttgggtttgggtgagtcagactcagtcaggacacagcatggacatgagggtccccgctcagctcctggggcttctgctgctctggctcccaggtgccagatgtgccatccagttgacccagtctccatcctccctgtctgcatctgtaggagacagagtcacatcacttgccgggnaagtcagggacaattaaaatgattagcctggtatcagacaagaaacagggaaaactcctaaaggtcctagatctatgatcgccttccgaaggtttggaaagtcggggtcccagttaccaaggttcgagtcggacaaggttggntcgtagggaactagtactttcactctaccactatccacagcctagccggtctaggaattattgactaacttattactagtactaatatttaattcttatccgtcttactacgttcggacggtaacggtaccgaagggtcgagtaacgtacgaaaacgttcttaggtcggactcggacctacttacgttcgttcgtttaacccg

SEQ ID NO: 434246 - DNA, 598 bp, Homo sapiens
  misc_feature: GZ8MTXP01B37CT.39.38.D05.1.454.CMB.2.raw
  modified_base (197)..(197): a, c, t, g, unknown or other
  modified_base (270)..(270): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggcagtcagagtcttaatgctggtgctggtatcagcaagaaccgaggaaacncccctaagctcgtggtctcgtggtcgccctctagtttgacgtaaaggtcgggtcccagtcgtaacggttcaggcgtttacagtagaatcgagggactaagtacttcactcacaccatacagtacaacgtgacagtcctggtacttatttgactaactttagttactggacctagctactttacttacttaacctttacccttagttacctttacgggccgtaaacggggtaacccaaggtacttaaggtaaacgtaacttaaacgaaaaacggttaccgttaaggtcggtaaccgttacgacccgttaccttaacgttcgtttaaccg

SEQ ID NO: 434247 - DNA, 618 bp, Homo sapiens
  misc_feature: GZ8MTXP01AJA8R.39.38.D05.1.454.CMB.2.raw
  modified_base (198)..(198): a, c, t, g, unknown or other
  modified_base (235)..(235): a, c, t, g, unknown or other
  modified_base (274)..(274): a, c, t, g, unknown or other
  modified_base (300)..(300): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatcgacccagtctccttccaccctgtctgcatctgtagganacagatcacatcacttgccggcagtcagagtcttaanagctggttgcctggtatcagcaagaaaccgagggaaacncccctaagctcctggtctcgtggtcncctcctagtttgaccgtaaaggttcgggtaccagtcgtaacggttcaggcggcaggtaagaactcgagggaacagtaacttcactctaccacatcacgacaacgtgactacgtccgtgtagttactttgacttaacttacttacgtcgaccacgtactaacttacttacttacctttacccttacgttacgttttacgggaccggtaacgggggtaaccttaaaggtaccgttaaaggtaacgtaacgttaaaccgttaaaacggttaaccgttgggtacggtaaccgttacggaccttaccgtaacgttcccgtttg

SEQ ID NO: 434248 - DNA, 633 bp, Homo sapiens
  misc_feature: GZ8MTXP01AEGXM.39.38.D05.1.454.CMB.2.raw
  modified_base (199)..(199): a, c, t, g, unknown or other
  modified_base (242)..(242): a, c, t, g, unknown or other
  modified_base (278)..(278): a, c, t, g, unknown or other
  modified_base (302)..(302): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatcgacccagtcctccttccaccctgtctgcatctgtagganacagagtcacatcacgttcggccgggcagtcagagttcttaanagcgtggtggctggatcagacaagaaacgaggaacnccctaagcctcgtgtctcgtgtcncctcgtagtttcgacgtaaggtcgggtaccagtcgaacggttcaggcggacagtaagagtcgtagggactaagtacttcactctaccacactacgagaccaacgtcgacgtacggtccgttagggttattacgtttacgaccttaaactttacggttacgtacgacctaacgtaccttaacttaactttaaccttaaccctttaacccttacgttaccgtttacggacccggtaaacgggtaacccttaggtcgttacggtacgtaacccgttaacggaaaaccgttcgttaacgggtcgtccgtacggacccacttaacgttcgttcccg

SEQ ID NO: 434249 - DNA, 517 bp, Homo sapiens
  misc_feature: GZ8MTXP01BDQOM.39.38.D05.1.454.CMB.2.raw
  modified_base (276)..(276): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtcttaatagctggttggcctggatcagcaagaaaccagggaaacncccctaagctctgtctctggtgcctctagtttgacgaaaggtcgggtcccatcaacggttcagcggcagtgaatcgagggacagattcactctacactatcagcaacgtgacagcctggtgtatttgactaacttacttactcgccagctacttattactaccttacctactactttcggctaagggacagcttaagagtattaacgaaagttactgtggctcgacacctaagttctaacg

SEQ ID NO: 434250 - DNA, 614 bp, Homo sapiens
  misc_feature: GZ8MTXP01A0ZLN.39.38.D05.1.454.CMB.2.raw
  modified_base (244)..(244): a, c, t, g, unknown or other
  modified_base (291)..(291): a, c, t, g, unknown or other
  modified_base (427)..(427): a, c, t, g, unknown or other
  modified_base (586)..(586): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatcgtggtaggagacagagtcaccatcacttcggccggcagtcagtagtacttaaagngtcgttgggttgccttggatcagacaaacggaaaccgacgggaaacncccctaagcctccgtgtcctcgtggtctccctcgtagtttgaacgtaaggtcgggtacccagtaccgtaaggtcaggcggactagtaacgaagtcgacgggtacagtaactcactctacacatcgacgacaacgtnaccgtagccgttggtctatttcgacgttaacttattaaccgcgtaccgacgtacttaaccttaacgttacctttaaccctttaacccgtacgttacgtttcgggaaccgaacggtaaccaggacttaaggaacgtaattaaacgaaacgttacgtaagnggtaacctacgcaactcgttcgtaaccg

SEQ ID NO: 434251 - DNA, 507 bp, Homo sapiens
  misc_feature: GZ8MTXP02FLPUW.39.38.D05.1.454.CMB.2.raw
  modified_base (390)..(390): a, c, t, g, unknown or other
tcagtcgcactagtcacgaccggtgctcgatttagtatctgatagttgggtttggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtcttaatagctggttggcctggtatcagcagaaaccagggaaagcccctaagctcctggtctctggtgcctccagtttgcaaagtggggtccatcaaggttcagcggcagtggatctgggacagattcactctcaccatcacagcctgcggcctgaagtntttgctaaacttattactgtactaaactaatttaacttcttatccgtcttcactttcggcggacgggaccaagggtggagatacaaacgtactgtaggctgcaccatctcgtcttac

SEQ ID NO: 434252 - DNA, 496 bp, Homo sapiens
  misc_feature: GZ8MTXP02JPHIB.39.38.D05.1.454.CMB.2.raw
tcagtcgcactagtcacgaccggtgctcgatttagtatctgatagttgggtttggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtcttaatagctggttggcctggtatcagcagaaaccagggaagcccctaagctcctggtctctggtgcctcagtttgcaaagtggggtcccatcaaggttcagcgcagtggatctgggacagattcactctcaccatcaccagcctgcgcctgaagatttgctaacttattactgttacaactaatttaattcttatccgctcactttcggcgagggaccaagggtgacgatacaaacgaactgtaggctgacacatctgtcttac

SEQ ID NO: 434253 - DNA, 528 bp, Homo sapiens
  misc_feature: GZ8MTXP02IOW9F.39.38.D05.1.454.CMB.2.raw
  modified_base (274)..(274): a, c, t, g, unknown or other
  modified_base (351)..(351): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtcttaatagctggttgcctggtatcagcagaaaccagggaacncccctaagctctggtctcgtggtcgcctctagtttgactaaaggtcggggtacccagtccgaaaggttcaaggccgnagtgaatcgtagggacaagtacttcactctcaccatcagcaacgtgacacgccgtggtatagtttgactaactttattactgcagctactattactacttaccttactactttcgacgtacgggaccaagtcgtaagagactaaacaaagacgtgtacgactacgacactactctcg

SEQ ID NO: 434254 - DNA, 596 bp, Homo sapiens
  misc_feature: GZ8MTXP02IM9ZS.39.38.D05.1.454.CMB.2.raw
  modified_base (197)..(197): a, c, t, g, unknown or other
  modified_base (276)..(276): a, c, t, g, unknown or other
  modified_base (391)..(391): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtcctccttccacctgtctgcatctgtagganacagagtcaccatcacttgccgggcagtcagagtcttaatagctggttgcctggtatcagcaagaaaccgagggaaacncccctaagcctccgtggtctcgtggtcgcctccgagtttcgactaaaggtcggggtcccaagtctaaggttcagcggcagtgaatcgtagggacagtattcactctacacatcancaacgtgacacgtcctggtgtatttgactaactttatactgaccctagacctacttattacttaccctttaacccttacttacgttttacggacccgtaacggggtaacccaaaggtaccgtaaagaacgtaacttaaaccgaaaaagtaaccgttaaggtacgggtaccttacggaaccctaccgtaacgtttaccgtttaccg

SEQ ID NO: 434255 - DNA, 535 bp, Homo sapiens
  misc_feature: GZ8MTXP02F11WQ.39.38.D05.1.454.CMB.2.raw
  modified_base (391)..(391): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtcttaatagctggtggcctggtatcagcagaaaccagggaaacgcccctaagctcctggtctctggtgcctcagtttgcaaaggtcggggtcccatcaaggttcagcgcagtgaatcgtgggacagaattcactctcacatcagcaacgtgcagcctggtntatttgactaactttattactgaccagcaacttattactactttaacccttactacgttttcggaccgtacggggaccaaaggcttaaaggagtaactaacgaaaagtaactgtacggacttacggacctaacctatctttacg

SEQ ID NO: 434256 - DNA, 521 bp, Homo sapiens
  misc_feature: GZ8MTXP02HHZH0.39.38.D05.1.454.CMB.2.raw
  modified_base (274)..(274): a, c, t, g, unknown or other
  modified_base (390)..(390): a, c, t, g, unknown or other
  modified_base (397)..(397): a, c, t, g, unknown or other
  modified_base (406)..(406): a, c, t, g, unknown or other
  modified_base (420)..(420): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtcttaatagctggttggcctggtatcagcagaaaccaggaacncccctaagctcctggtctcgtggtcgcctcgtagtttgacgtaaaggtcggggtaccctagtcgaacggttcagtcggcagtgaatcgtagggacagaattcactctcaccatcancaacgtncagctggtntattgactaacttntactgacagctattatataccttaccttactacgtttcgacgtacgggaccagcgtaggacactaacgaacgaactggtacgctacgcactacttcgtacg

SEQ ID NO: 434257 - DNA, 570 bp, Homo sapiens
  misc_feature: GZ8MTXP02GH7FG.39.38.D05.1.454.CMB.2.raw
  modified_base (371)..(371): a, c, t, g, unknown or other
  modified_base (379)..(379): a, c, t, g, unknown or other
  modified_base (411)..(411): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccatcttccgtgtctgcatctgtaggagacagagtcaccatcacttgtcgggagagtcaggggtattagcagctggttagcctggtatcagcaagaaaccagggaaacgcccctaagctcctgatctatgctgcatccagtttgactaaaggtcggggtacccatcgaaggttcagttcggcagtggatcgtagggacagtnttcactcncacatcagcacgcctgacacgacctagaagtnttttgactaactttacttagttcgtacaaacgtacggtactaaacgtacggtttaccccggaggtaccggttaccggaccgtaaacggggaccgtaaagggtacgggtaaaactaacgtaaaacgtaacgtaggtacggtacgtacgaccgtactaacg

SEQ ID NO: 434258 - DNA, 702 bp, Homo sapiens
  misc_feature: GZ8MTXP02HILET.39.38.D05.1.454.CMB.2.raw
  modified_base (197)..(197): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggcagtcagagtcttaatagctggtgcctggtatcagcaagaaaccgaggaaacgcccctaagcctaccgtggtcctcgtggtcgtccctccgtagttttcgacgtaaaacgggtcggggtaccccaagttaccgaaaacgggtttccgaacggtccgggtacgtaaaggttaggaaacgtttccgggtagggggaaacctaaaggtaaactttccaacttccttaccaaccctaataccgaacgaccaaacggttcgacgaacggcccgtttagggtacgttagttttacgaccttaaactttactttaacgtcgacctaacgacctaacttaactttaacttaaccctttacccttaacgtttacgttttacggaccgttaacgggggaaccctaaaggtaccttaaaggaaacgtaactaaacgtaaaaacgtaccgtaaggtacggtaaccgtacgaaccaccgtaactttaccgttcg

SEQ ID NO: 434259 - DNA, 605 bp, Homo sapiens
  misc_feature: GZ8MTXP02GJ7XH.39.38.D05.1.454.CMB.2.raw
  modified_base (235)..(235): a, c, t, g, unknown or other
  modified_base (249)..(249): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtctaangctggtgctggtancagacagaaaccagggaacgcccctaagcctcgtgtctcgtggtcgtcctctagtttcgacgtaaaggtcggggtacccagttaccgaaacgggttcacgggacggcgtaaggtacgaacgtcgtcgggggaaactaaggtaactttccaaccttcctacctaacccgacttacgacgtacgaacgtcgacgacgtccgttggtcgttatttcgacttaaactttattactgaccaagtctacttaacttacttaaccttaccttacttacgtttcggaccgtacggggaaccacgtacgtaacgagtaactaacgtaaacgtaacgtggtcggtactcgaccacctacttcttcg

SEQ ID NO: 434260 - DNA, 751 bp, Homo sapiens
  misc_feature: GZ8MTXP02G2R1F.39.38.D05.1.454.CMB.2.raw
  modified_base (284)..(284): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttcggcccgggcagtcagagttactaatagctgggttgcctggtatcgagacaagaaaccgagggaaacnccccgtaagcctccgtggtctcgtggtcgtcctccgtagtttcgacgtaaacgggtcggggtacccagtacgtaacggttcacggtcggacgtaggtacgaacgtccggtagggaactaagtaacttccaactcctaccaacctactacgacgaccgaacgtgaccgacggtccgttaggttagttacgttttacggaacctttaaactttacgttaccgtaccggtacccgtaagttaaccttaaactttaactttttaaacccgtttaacccctttttaaacccccgttaaaccgttttaccggttttaccggggaaacccccgggttaaaagggggtaaacccccaaaggttaccggttaaaacggaaacggttaaaacctaaaaccggtaaaaaacggtaacgttaacggggtacggtaccgttaacggaccccgtaaacctttacgttaacccgttttaccg

SEQ ID NO: 434261 - DNA, 601 bp, Homo sapiens
  misc_feature: GZ8MTXP02JHHP2.39.38.D05.1.454.CMB.2.raw
  modified_base (242)..(242): a, c, t, g, unknown or other
  modified_base (291)..(291): a, c, t, g, unknown or other
  modified_base (373)..(373): a, c, t, g, unknown or other
tcagtcgcactagtcacgaccggtgctcgatttagtatctgatagttgggtttgggggagtcagactcagtcaggacacagcatggacatggagggtccccgctcagctcctggggctcctgctgctctggctcccaggtgccaaatgtgacatccagatgacccagtcctccttccaccctgtctgcatctgtaggagacagagtcaccatcacgttcgccgggcagtcagtagtcttaanagcgtggttcggcgtggtactcgagacgaacgaaaccgaagggaaaccnccccgaagcctcgtcggtcctgtcggtcgcctcgtagtttcgacgtaaacggtcgggtccaagtcgaacgtcgaggcgacgngtacgatcgtagggactagtactacactccgtacacctataccgacgacgaacgttcgacgtacggtccttaggtacgttagtttctaactaaactttacgtacgttacgcgacttactaacttacttacttaaccgttacctttactacgtttcggaccgtacgggtaccaagcgtaagtaacgacaaacgaagtaagtcgtcgactacgacccagtactctttacg

SEQ ID NO: 434262 - DNA, 633 bp, Homo sapiens
  misc_feature: GZ8MTXP02I7S11.39.38.D05.1.454.CMB.2.raw
  modified_base (197)..(197): a, c, t, g, unknown or other
  modified_base (236)..(236): a, c, t, g, unknown or other
  modified_base (268)..(268): a, c, t, g, unknown or other
  modified_base (292)..(292): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtctccttccaccctgtctgcatctgtaggancagagtcaccatcacttgccgggcagtcagagtcttaangctggtgctggtatcagcagaaacagggaacnccctaagctcgtgtctcgtggtcncctccagtttgacgtaaaggtcggggtccctaagtcgtaacggttcgacggcggacgtagtacgtaaagtcggtagggaactacgtaattccgaactcctaccgaacctacttacaacgtcgaaacgtcgactacggtcccgttaggttacgttactttacgtaccttaaactttacttacttcgaccgtacgtactaacttactttaacttaactttaacccttacgttaccgtttacggacccgttaaacggggacctaaaggtccgtaaagaacgtaacgttaaacgaaaacgttaaacgtggttaacggctaacggaccgtacctagtttacttacg

SEQ ID NO: 434263 - DNA, 743 bp, Homo sapiens
  misc_feature: GZ8MTXP02JE3FK.39.38.D05.1.454.CMB.2.raw
  modified_base (290)..(290): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctccaggtgccaaatgtgacatccagatgaccagtctccttccaccctgtctgcatctggtaggagacagagtcaccatcacttcggccgggccagtcagagttacttaagaggtcgttgggttcggcctgggtatcgagacaacgaaaccgaggaaacnccccgtaagccttaccgtgtactcgtggtcgtcccttacgtagtttcgacgtaaagggttccgggtacccagttacgaaccgggtttacgacgtaccgggacgtagggttggtacgtccggtagggggaaacttacgggtaacttttccaaccctttacgaccctaaacccgtctaaccctacccgaaacggtcccgttcgggacccgtaccgttaaggttaaaacgttacgggtttttacgaacctttaaaacggttttactttaacccgtagttaaccccttaaaatttaacgttttaaacctttcgtttaaactcccggtacttacttacgggtttaccggggacggaagggttaaccggtagggtaggtaacgtaaaccgttaaacgaaccggtaagttcggtaacgtcgttacggaaccgaaccgttagtccgtttacttacgtttac

SEQ ID NO: 434264 - DNA, 672 bp, Homo sapiens
  misc_feature: GZ8MTXP02JBI7B.39.38.D05.1.454.CMB.2.raw
  modified_base (246)..(246): a, c, t, g, unknown or other
  modified_base (449)..(449): a, c, t, g, unknown or other
tcagtcgcactagtcacgaccggtgctcgatttagtatctgatagttgggtttgggggagtcagactcagtcaggacacagcatggacatgagggtccccgctcagctcctggggctcctgctgctctggctcccaggtgccaaatgtgacatccagatgacccagtcctccttccaccctgtctgcatctaggtaggagacagagtccaccatctacgttcgccgggcagtcagtagtacttaanagtcgtggttggcctggtactcgagacaacggaaaccgaagggaaaccgacccctaagtcctccgtcggtcctcgttggtcgtcctccgtaggttcgacgtaaaggtcgggtacccagtacgtacggttcacggcgtacaggtacgtaactcgggtagggactagttacttccgactcctaccacactccaaccgcggtcccncggtccgacgtagtaattcgttacgacttaaacgttacttacgtacttaaccgtaaaactttagttttaaacttccgttaacgttcccgtacctttcggttacccgtttaccggacggttacgggaaccggggtaaacgtaggggtacggtaaacgtaaacgtaaccgaaaacgtaccgttaggtaacgtctacggacctaacgtctttcggtactttacccg

SEQ ID NO: 434265 - DNA, 543 bp, Homo sapiens
  misc_feature: GZ8MTXP01B8Q1Z.39.29.C07.1.454.CMB.2.raw
  modified_base (238)..(238): a, c, t, g, unknown or other
  modified_base (251)..(251): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccacagtgtttanacagaccctaaanaataacaactacttaactgatcagcaagaaataggccagccctacctaaagcgactctatttcctgggcacgtccgtaacccggggatcccggggtcctgaccgtattcagtggcaggccgggtcgtgggacagtatttcactctacaccatcagcacgcctcgaggctagagatgtggctagtttatactgtcagcagtatagttgattagttccggtggtacgttcggacgaaagggaccaagggtacgaacttacgaaacgacgtgtggaactgacactaacttcgtcg

SEQ ID NO: 434266 - DNA, 545 bp, Homo sapiens
  misc_feature: GZ8MTXP01DOW74.39.29.C07.1.454.CMB.2.raw
  modified_base (235)..(235): a, c, t, g, unknown or other
  modified_base (247)..(247): a, c, t, g, unknown or other
  modified_base (403)..(403): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaaanaataacaactacttaactgtatcagcaagaattaggccagcctacctaagcgactcatttcctgggcatctaccgggatcccgggtcctgaccgattcagtggcagcgggtctgggacagatttcactctcaccatcagcagcctccaggctgaanatgtggactagtttatactgtacagtcaggtatattagattagttccgtgggtaaccgttcgggacccaaagggggtacccaaaggttcgggaaacttacgaaaacgaaacgtggtaggcctgaccttacctaagttccttg

SEQ ID NO: 434267 - DNA, 516 bp, Homo sapiens
  misc_feature: GZ8MTXP01BPKF5.39.29.C07.1.454.CMB.2.raw
  modified_base (226)..(226): a, c, t, g, unknown or other
  modified_base (235)..(235): a, c, t, g, unknown or other
  modified_base (247)..(247): a, c, t, g, unknown or other
  modified_base (308)..(308): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccanagtgtttanacagccctaaanaataacaactactaactgatcagcaagaaataggccagcctacctaagcgactcatttccnggcatctaccggaatccgggtcctgaccgattcagtgcagcgggtctgggacagattcactctcaccatcagcagcctcaggctagaagatgtggactagtttatactgtcagcagatattagatattccgtggacgttcggccaaagggacccaaaggttacggaacttacgaaaacgaacgttggaggctcgcacctaattccttg

SEQ ID NO: 434268 - DNA, 518 bp, Homo sapiens
  misc_feature: GZ8MTXP01AXLU0.39.29.C07.1.454.CMB.2.raw
  modified_base (236)..(236): a, c, t, g, unknown or other
  modified_base (309)..(309): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacagccctaaacaataacaactacttaactggatcagcagaaattaggccagcctctaagcgactcatttccngggcatctaccgggatccgggtcctgaccgattcagtgcagcgggtctgggacagatttcactctcaccatcagcagcctcgaggctagaagatgtggctagtttatactgtcagcagatagttagatagttccgtggaacgttcggaccaaaggggaccaagggtaggaacttacgaaacgaacgtgtggctgaccacaacttcgtcg

SEQ ID NO: 434269 - DNA, 508 bp, Homo sapiens
  misc_feature: GZ8MTXP01CWB1I.39.29.C07.1.454.CMB.2.raw
  modified_base (246)..(246): a, c, t, g, unknown or other
  modified_base (268)..(268): a, c, t, g, unknown or other
  modified_base (308)..(308): a, c, t, g, unknown or other
  modified_base (336)..(336): a, c, t, g, unknown or other
  modified_base (400)..(400): a, c, t, g, unknown or other
  modified_base (424)..(424): a, c, t, g, unknown or other
tcagtcgcactagtcacgaccggtgctcgatttagagtgctacgaagggaaagggggagctacaacaggcaggcaggggcagcaagatggtgttgtagacccaggtcttcatttctctgttgctctggatctctggtgcctacggggacatcgtgatgacccagtctccagactccctggctgtgtctctgggcgagaggccaccatcaactgcaagtccagccacagtgtttatacagccctaanaataacaactacttaactgtancagcagaaataggccagcctcctaaagcgactcatttccnggcatctacccggatccgggcctgacgnttccagtgcagcggtctgggcagatttcactctcaccatcagcagcctccaggctgaagatggngctagtttattacgtgtcagcagntattgatacgttcgtgacgttcggccgtaagggaccaaggttcgaaactcaaacgacttagtggctcgctaccatccttgttcc

SEQ ID NO: 434270 - DNA, 551 bp, Homo sapiens
  misc_feature: GZ8MTXP01D34Z9.39.29.C07.1.454.CMB.2.raw
  modified_base (228)..(228): a, c, t, g, unknown or other
  modified_base (237)..(237): a, c, t, g, unknown or other
  modified_base (250)..(250): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccanagtgtttanacagaccctaaanaataacaactacttaacttgatcagcaagaataggccagccctacctaaagcgaactctaatttccgtgggcagttccgtaccccggggaagtcccgggtcctgaccgtattcgagtgcaggcgggtctggggacagtactttcactcgtcaccatcacgcacgcctcgaggctagaagatgtggactagtttatacgtgtcagcagtatattagatagttccgtggaccgttcggacttaaagggaccaaggtacggaacttacgaaacgaacgtggtggctcgcttaaccgtgttcgtg

SEQ ID NO: 434271 - DNA, 592 bp, Homo sapiens
  misc_feature: GZ8MTXP01AWB3U.39.29.C07.1.454.CMB.2.raw
  modified_base (227)..(227): a, c, t, g, unknown or other
  modified_base (236)..(236): a, c, t, g, unknown or other
  modified_base (319)..(319): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccanagtgtttanacagaccctaaacaataacaactacttaacttggatcagacaagaaattaggccagccctacctaagcgactctactttccgngggcatccgtaacccgggaactcccggggtcctgaccgtacttcaggtggcaggcgggtctggggacagtactttcactctcaccatcagcacgccctcaggctagaacgagtgtggtactagtttacttacgtgtaccagtacaggtattagttagtattacgttccggtcggtacggttccggacgaaaggggtacccaaagggtacggtaaaccaccgttaaaaccggacgttaagggtcgtaacgtggaccaaccgtcttaacgttccg

SEQ ID NO: 434272 - DNA, 570 bp, Homo sapiens
  misc_feature: GZ8MTXP01BLCCE.39.29.C07.1.454.CMB.2.raw
  modified_base (226)..(226): a, c, t, g, unknown or other
  modified_base (236)..(236): a, c, t, g, unknown or other
  modified_base (250)..(250): a, c, t, g, unknown or other
  modified_base (268)..(268): a, c, t, g, unknown or other
  modified_base (271)..(271): a, c, t, g, unknown or other
  modified_base (276)..(276): a, c, t, g, unknown or other
  modified_base (306)..(306): a, c, t, g, unknown or other
  modified_base (362)..(362): a, c, t, g, unknown or other
  modified_base (386)..(386): a, c, t, g, unknown or other
  modified_base (389)..(389): a, c, t, g, unknown or other
  modified_base (396)..(396): a, c, t, g, unknown or other
  modified_base (408)..(408): a, c, t, g, unknown or other
  modified_base (412)..(412): a, c, t, g, unknown or other
  modified_base (549)..(549): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccanagttgtttanacagcccctaaaanaataacaactactatgancanacaanaatcgacagcctacaagcactctacttcgnggacactccgtaccggacgtccggtcctgacctctcgagtcgacgacggcgggtcnggactagtacttcactctacacancancacgccncgagctagaagntggngtacttagtttatacgtgtacagcgtaagtattagttagtacttacgttccggtacggtaccggttaaccggaacgaaacgggtaaccgttaaagggtacggtaaaccttaaccgaaacggttacgtggtcgtaacncgaccttacctcgttccgtcg

SEQ ID NO: 434273 - DNA, 582 bp, Homo sapiens
  misc_feature: GZ8MTXP01CCSNI.39.29.C07.1.454.CMB.2.raw
  modified_base (240)..(240): a, c, t, g, unknown or other
  modified_base (457)..(457): a, c, t, g, unknown or other
  modified_base (562)..(562): a, c, t, g, unknown or other
  modified_base (575)..(575): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccacagttgttttanacagaccctaaacaataacaactacttaacttggtatcagacaagaaattacggaccagccctacctaagcgactctactttccgtgggctacgtaccgtaaccccggggaacgttccccgggggtaccctcggaaccgtacttcgaggtcgggcagggccgggtctggggacaggtactttcactctcacagtcagcacgcctcgaggctagaagntgtgctagttttatactgtacagcgaggtatagttgattacgtccgtaggtccggttaacggaccgaagggtaccaagggtacgaacttacgaaacgttacgtgngctcgacaccgtnttcgtcg

SEQ ID NO: 434274 - DNA, 524 bp, Homo sapiens
  misc_feature: GZ8MTXP01DY86W.39.29.C07.1.454.CMB.2.raw
  modified_base (235)..(235): a, c, t, g, unknown or other
  modified_base (246)..(246): a, c, t, g, unknown or other
  modified_base (436)..(436): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactactaacttggatcagcaagaaattaggccagccctacctaagcgactcatttcctgggcatctacccgggaatccggggtcctgaccgattcagtggcagcgggtctgggacagatttcactctcaccatcagcagcctccaggctgaagatgtggactagtttattactgtcagcaggntattgattagtccgtggacgttcggccaaaggggacccaaggtacggaacttacgaaacgaactggtaggctggcaccgtaattcgtg

SEQ ID NO: 434275 - DNA, 572 bp, Homo sapiens
  misc_feature: GZ8MTXP01DH9WJ.39.29.C07.1.454.CMB.2.raw
  modified_base (237)..(237): a, c, t, g, unknown or other
  modified_base (251)..(251): a, c, t, g, unknown or other
  modified_base (403)..(403): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacacgaccctaaanaataacaactacttaacttggtatcagacaagaaattaggccagccctacctaaagcgactctatttccgtgggcatccgtacccggggaattccccgggggtccctagaccgtacttcagtggcaggcgggtctgggacagtattcactcncacatcagcacgcctcaggctagaagatgtggctagtttattacgtgtacacgataaggtattagttagaacttagttccggtacgggaacggttcggaaccgttaaagggaaccgaaagggtacggaacttacgaaacgaacgtgtggctgtacacctaagttcgtcg

SEQ ID NO: 434276 - DNA, 659 bp, Homo sapiens
  misc_feature: GZ8MTXP01EMCIM.39.29.C07.1.454.CMB.2.raw
  modified_base (242)..(242): a, c, t, g, unknown or other
  modified_base (256)..(256): a, c, t, g, unknown or other
  modified_base (334)..(334): a, c, t, g, unknown or other
  modified_base (642)..(642): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccactagttgtttanacacgaccctaaanaactaacaacttacttaacttggatacagacaagtaaagttacggcctacgcctactaaagccgtactctatttccgngggacacgttaccgtacccgggggacgttcccggggtccctaggaccgtacttccggaggtcggacgtagggtcccggggttcgtaacggggaactaggttactttcccgaaccttctaccctaaccctatccgaacgacccgacggtcccctacggaaggtccttaaggaaacgtgttcgggtagtacttaagttttagttacgtggtacagtcgtaaggtatttagtagtacgttcgtccggtagggtccggttaacgaacggaaagggaccgttagggactaaacttacgaaacgttagtggcgncgacacctgttcgttcg

SEQ ID NO: 434277 - DNA, 654 bp, Homo sapiens
  misc_feature: GZ8MTXP01BTHMU.39.29.C07.1.454.CMB.2.raw
  modified_base (226)..(226): a, c, t, g, unknown or other
  modified_base (236)..(236): a, c, t, g, unknown or other
  modified_base (249)..(249): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccanagttgtttanacagaccctaaanaataacaactacttaacttgatcagacaagtaaatggccagcctaccgtaagccgactctatttccgtgggcctacgtccgtaaccccggggtaagttccccgggggtacccctacggtacccgtactttccgaggttcggggacctagggtaccgggggttccgtgggggaacctaaggttacttttaccaaccgttctacccaaccctactaccgaacgccaacgcccctaccgaaggtcctaggaagagtggtgacgttagtttaattacgtgtacgagcgaaggtattagttgattacgttccgtagggtaccgttcggaccgaaaggggtacccgaaagggtacgaaaccgttacgaaacggttaacgtggtagggctacggacttacctaagttcttcg

SEQ ID NO: 434278 - DNA, 566 bp, Homo sapiens
  misc_feature: GZ8MTXP01DMK1N.39.29.C07.1.454.CMB.2.raw
  modified_base (238)..(238): a, c, t, g, unknown or other
  modified_base (251)..(251): a, c, t, g, unknown or other
  modified_base (316)..(316): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccacagtgttttanacagaccctaaanaataacaactacttaactgatcagcaagaaatagccagccctacctaaagcgactctactttccngggcacgtaccgtaccccgggaagtcccgggggtccctgaccgtacttccgagtggcaggcgggtctgggacagtatttcactctcaccatcagcacgcctacgaggctagaacgatgtgactagttttattacgtggtcagctaaggattagttagattacgttcggtggtacgttccggacgaaagggaccaagggtacggaacttacgaaacgttacgtgtacggctggacaccgtaattcgtaacg

SEQ ID NO: 434279 - DNA, 536 bp, Homo sapiens
  misc_feature: GZ8MTXP01BZORP.39.29.C07.1.454.CMB.2.raw
  modified_base (237)..(237): a, c, t, g, unknown or other
  modified_base (314)..(314): a, c, t, g, unknown or other
  modified_base (382)..(382): a, c, t, g, unknown or other
  modified_base (410)..(410): a, c, t, g, unknown or other
  modified_base (529)..(529): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccacagttgttttanacagaccctaaacaataacaactacttaactgatcagacaagaaattaggccagccctactaagcactcatttccgnggcatcgtaccgggatcccgggtcctgacctattcagtgcaggcgggtctgggacagtatttcactcncacatcagcagccctcgaggctagaagntgtggacttagttttatacgtgtaccagacaggtattattgattacgttccggtggacgttcggaccgttaaggggaccaagggtacgaacttacgaaacggactggcggctcgcactnttcgtcg

SEQ ID NO: 434280 - DNA, 653 bp, Homo sapiens
  misc_feature: GZ8MTXP01C2CDQ.39.29.C07.1.454.CMB.2.raw
  modified_base (239)..(239): a, c, t, g, unknown or other
  modified_base (252)..(252): a, c, t, g, unknown or other
  modified_base (320)..(320): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccacagttgttttanacagaccctaaanaataacaactacttaacttggatcagacaagaaattaggccagccctactaagcgactctatttccgnggctacgtccgtacccgggtaagtcccgggggtaccctggtacccgtagtttccgaggttcggccgagggtcccggggttcgtcgggggaacctaaggttactttaccacctctaccaccatcaggccacgccctaccgaaggtctagaaacgtagttggtacggtacttaaggtttacttaacgtgttaccgaggaccgtaagggtaattagttaggtaacttacgtttccggtagggtaccggttaaccgggaaccggaaacggggtaaccaaagggtaacggaaccttaacgaaacgttacgtggtagcgtacgcacctaagttcgttcg

SEQ ID NO: 434281 - DNA, 582 bp, Homo sapiens
  misc_feature: GZ8MTXP01D44QE.39.29.C07.1.454.CMB.2.raw
  modified_base (238)..(238): a, c, t, g, unknown or other
  modified_base (251)..(251): a, c, t, g, unknown or other
  modified_base (321)..(321): a, c, t, g, unknown or other
  modified_base (566)..(566): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccacagttgtttanacagaccctaaanaataacaactacttaacttggatcagacaagaaattacggccagccctacctaagcgactctatttccgngggctagtccgtaacccgggaattcccgggggtcctcgaccgtacttcgaggtcggcaggccgggttctggggactagtactttcactctacaccatcagcacgcctcgaggctagaagtagtggtaggtacttaaggttttactacgttgtacgagtcgtaaggtattagttagtattacgttcggtggacggttcggacgaagggtaccgaaggtacgtaacttacgaaacgacgtggtaggntcgacactgttcttcg

SEQ ID NO: 434282 - DNA, 624 bp, Homo sapiens
  misc_feature: GZ8MTXP01CAB5J.39.29.C07.1.454.CMB.2.raw
  modified_base (241)..(241): a, c, t, g, unknown or other
  modified_base (255)..(255): a, c, t, g, unknown or other
  modified_base (319)..(319): a, c, t, g, unknown or other
  modified_base (345)..(345): a, c, t, g, unknown or other
  modified_base (371)..(371): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccactagttgtttanacacgaccctaaanaataacaactacttaactgatcagacaagtaaatacggccagcctactaagcactctacttcgnggcatccgtaccgggatccgggtccngaccgtattcgagtgcaggcgggtcnggacagtattcactctacacatcagcacgtcctacgaggtctaggaagtgtggtacggtacttaaggttttaacttacgtggttaccgaacggtacgtaaggtattaagttagtaacgtttaacggtttcccgggtagggtaccggttaacccgggaacgttaaacgggggtaaccgttaaaggggtacgtaaaccttaacggaaaacggttacgtgggtacgtcgtacgacccgttacctaagttccgttcg

SEQ ID NO: 434283 - DNA, 692 bp, Homo sapiens
  misc_feature: GZ8MTXP01EE9RS.39.29.C07.1.454.CMB.2.raw
  modified_base (244)..(244): a, c, t, g, unknown or other
  modified_base (257)..(257): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggcccaccatcaactgacaagtccagccactagttgttttanacagaccctaaanaataaacaactacttaacttggatacagacaaagtaaatacggacccaagtccctaacctaaagcctaactctaacttttccgagggacctacgttaccgtaaccccgggggaacttccccgggggtaccctagaacccgtattccgaggtcggacgacggtccgggtctggggaactaagtacttttaccaaccttctaccaaacctatacaacgccacgtcccctaccgaaggtccttaaggaaacgtagttggtacggtaacttaaggttttaacttacgttggtaccagtacgaaggtattagttacgaagttaccgttccggtaggtaccggttaacggaaccggttaaacgggaaccgttaaagggtacgtaaaccttaacgaaaacgttaaccggtgttgaaccgtacgaccactaacttcgttaacg

SEQ ID NO: 434284 - DNA, 683 bp, Homo sapiens
  misc_feature: GZ8MTXP01CHI3W.39.29.C07.1.454.CMB.2.raw
  modified_base (224)..(224): a, c, t, g, unknown or other
  modified_base (245)..(245): a, c, t, g, unknown or other
  modified_base (310)..(310): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctggcgagaggccacatcaactgcaagtccagccanagtgtttatacagccctaaanaataacaactacttaactgtatcagacagaaattaggccagcctactaagcgactctatttccgnggcatcgtacccgggagtcccggggtccctggacccgtattcgagtcggcaggtccggggttactggggacctaggtacttttccgaaccttcctacaacccctattccgaacgccgaacgtccccttaccgacgggtccgttaggaaacgtagttgggtacggtaccttaaggtttttaaacggtttacccgttagggttacccaaggtaccgtaagggtaattaatttagggtactttaacgtttccgggtacgggtaccgtttaacccggggaacccttaaagggggaaccccttaaaggggtaacgggtaacttaaccggaaacgttaaccgttggtacgggctacggaccaccgtaacttcgttaacg

SEQ ID NO: 434285 - DNA, 657 bp, Homo sapiens
  misc_feature: GZ8MTXP01DR7HZ.39.29.C07.1.454.CMB.2.raw
  modified_base (241)..(241): a, c, t, g, unknown or other
  modified_base (255)..(255): a, c, t, g, unknown or other
  modified_base (321)..(321): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccactagttgtttanacacgaccctaaanaataacaactacttaactgatcagcaagtaatcggccagcctacctaagccgactctactttccgnggctacgttccgtaaccccggggtaacgttccccgggggtccctacggaccgtacttcgaggtcggcgaggccgggtcgtgggactagtacttccactctcacatcacgcacgcctacgaggctagaagtagtgtagacttagtttattacgttgtaccagacgtaaggtattagttagtatttacgttaccgggttgggtaacccggttccggggaacccggttaaagggggtaaccccttaaagggggtaacgtaaaccgttaaaccgaaaaccgggttaacggtcgggttacgggtccttacggaccccttaccgtaacgttccgtttaaccg

SEQ ID NO: 434286 - DNA, 558 bp, Homo sapiens
  misc_feature: GZ8MTXP01B0IO5.39.29.C07.1.454.CMB.2.raw
  modified_base (236)..(236): a, c, t, g, unknown or other
  modified_base (312)..(312): a, c, t, g, unknown or other
  modified_base (404)..(404): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacagccctaaacaataacaactacttaacttggatcagcaagaaattaggccagcctcctaagcgactcatttccnggcatctaccgggatccgggtcctgaccgattcagtggcagcgggtctgggacagtatttcactctcacatcagcagcctcaggctagaagntgtgactagtttatactgtcagcaggatagttgattagttcccggtagggtaccgttcgggaccgaaagggggtacccgaaaggggttacgggaaaccttacggaaaaaccgttaaccgtggtacgggcttacggccacctaagttccgtttcg

SEQ ID NO: 434287 - DNA, 604 bp, Homo sapiens
  misc_feature: GZ8MTXP01CUIDZ.39.29.C07.1.454.CMB.2.raw
  modified_base (235)..(235): a, c, t, g, unknown or other
  modified_base (248)..(248): a, c, t, g, unknown or other
  modified_base (311)..(311): a, c, t, g, unknown or other
  modified_base (342)..(342): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccacagtgtttaanacagaccctaaanaataacaactacttaacttgatcagcaagaaattggccagcctacctaagcactcatttccgnggacacgtccgtaccggacgtcccgggtccngacgtactcgaggtcggcgaggtcgggtcgtgggaactagttactttccacctcctaccaacctatacgacgccacgcccgtaccgaggtctaaggaaagtgttcgtacggtacttaagtttacgttacgtggtacagtacgtaaggtattagttagtacgttacgttccggtacggtaccggtaacggaacgaaacggggtacgaagggtacgaacttaacgaaacgttacgtgtacgtctcgaccttactaacgttcgtg

SEQ ID NO: 434288 - DNA, 670 bp, Homo sapiens
  misc_feature: GZ8MTXP01C3G08.39.29.C07.1.454.CMB.2.raw
  modified_base (242)..(242): a, c, t, g, unknown or other
  modified_base (256)..(256): a, c, t, g, unknown or other
  modified_base (327)..(327): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccatagttgttttanacacgaccctaaanaataacaacttacttaactgatcagacaagtaaattacggaccagccctactaagcgtactctatttccgngggactacgtccgtacccggggtaattccccgggggtaccctggaacccgtattccgaggtcggacgagggtccggggttacgtggggaactaggttactttccgactcctaccgaaccctagtaccacggaccacggcccctaccgaaggtccgtaggaaacggtagttggtacggtaactttagttttaacttaacgtcggttacacggacttaggaattagtttagtagttacgttccgggtacggttaccgggttaacggaaccggttaacggggaacaagggtacgtaacgttaacgaacgttaacgtggtacggctaggccttacgttgttcgttcg

SEQ ID NO: 434289 - DNA, 755 bp, Homo sapiens
  misc_feature: GZ8MTXP01E3LD5.39.29.C07.1.454.CMB.2.raw
  modified_base (230)..(230): a, c, t, g, unknown or other
  modified_base (241)..(241): a, c, t, g, unknown or other
  modified_base (254)..(254): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtggcgagacgggccaccatcaactgacaagtccagccanagttagtttanacagaccctaaanaataacaactacttaacttggtatcagacaagtaaaacgttacggaccctaacgacccctaccgtaaacggccgtaacctctaactttcccgtgggggacctacttacccggtaaccccggggtaagttccccgggggtccctaggaacccgtattacgaggtcggaccgtaggggtcgggttctgggggaactaggtactttccaaccttcctaccaccctataccgaacgaccgacgtcccgtacccgaaggggtctaagggaaacgtgttacgggtggtaaccttaaggttttaacgttacgtagggttaccaaggtaccggtaaaggttaatttaacgttagtaacgtttaacggttcccggaacgggttaccgggttaaccgggaaccggttaaacggggaaacccggttaagggtaaacggtaaacccgttaaacgttaaaacggttcgttaagggtcgtaacggttcaacgttaccctaacgttcgtttaaccg

SEQ ID NO: 434290 - DNA, 515 bp, Homo sapiens
  misc_feature: GZ8MTXP01AQLUY.39.29.C07.1.454.CMB.2.raw
  modified_base (225)..(225): a, c, t, g, unknown or other
  modified_base (233)..(233): a, c, t, g, unknown or other
  modified_base (244)..(244): a, c, t, g, unknown or other
  modified_base (303)..(303): a, c, t, g, unknown or other
  modified_base (361)..(361): a, c, t, g, unknown or other
  modified_base (372)..(372): a, c, t, g, unknown or other
  modified_base (377)..(377): a, c, t, g, unknown or other
  modified_base (402)..(402): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggctaccatcaactgcaagtccagccangtgtttanacagccctaanaataacaactacttaactgatcagcagaatggccagcctctaaagcgactcatttccgngggcatcgtacccgggatccgggtccctgaccacttcagtggcagcgggtctgggacngtatttcatcncaccntcagcagccctcaggctagagatgnggctagtttattacgtgcagcaggtatgttagattacttccggtgacgttcggacgaacggacgaggtacgaattacgaaaccgagtaacggtgctcgcacctaagttcgttc

SEQ ID NO: 434291 - DNA, 708 bp, Homo sapiens
  misc_feature: GZ8MTXP01DRFZB.39.29.C07.1.454.CMB.2.raw
  modified_base (243)..(243): a, c, t, g, unknown or other
  modified_base (257)..(257): a, c, t, g, unknown or other
  modified_base (334)..(334): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccactagttgttttanacacgaccctaaanaataaccaacttacttaacttggtatcgagacaaagtaatacggccagccctacgtaagccgtactctactttccgngggtacctaacgttacccggtacccggggtaacgttcccccgggggtaccctcggaacccgttaacttccgaacgggtcggacccgtaaggggtcccgggggttacttaacggggggaactaacgggttacttttacccaaccgttcctaccaaccctactccgaacggtccacgtccctaccgaagggtcctaaggaaagtgttagggtaggtaccttaaggtttttacttaacgtggtaccagtacgaaggtattagtagtaattcgttccggacgggtaccgtccgggaacgaacgggtaccgttaaaggtacggaaaccttaacgaaacggttacgtgggtacgtcgtcgaccttactaacgttctttcg

SEQ ID NO: 434292 - DNA, 602 bp, Homo sapiens
  misc_feature: GZ8MTXP01B79TA.39.29.C07.1.454.CMB.2.raw
  modified_base (242)..(242): a, c, t, g, unknown or other
  modified_base (256)..(256): a, c, t, g, unknown or other
  modified_base (280)..(280): a, c, t, g, unknown or other
  modified_base (317)..(317): a, c, t, g, unknown or other
  modified_base (382)..(382): a, c, t, g, unknown or other
  modified_base (431)..(431): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgacaagtccagccatagttgtttanacacgaccctaaanaataacaactacttaactgatcanacaagaatacgccagcctactaagcactctattccgngggactagtccgtaacccgggattcccggggtcctaggaccgtacttcgagtcggcaggcgggtntgggactagtatttcactctacacatcagcacgcctacgagtcagaagngtgtggacttagtttactacgtcgtacagacgtaagtattagttagtacttacggttccggtacgggtacgttcccgggaaccgaaacggggtaccgaaagggttaaccggtaaacttaaccgaaaacggttacgtgggtacggtctacgaccacgtaacgttcgttaacg

SEQ ID NO: 434293 - DNA, 505 bp, Homo sapiens
  misc_feature: GZ8MTXP01BQ1O8.39.29.C07.1.454.CMB.2.raw
  modified_base (224)..(224): a, c, t, g, unknown or other
  modified_base (233)..(233): a, c, t, g, unknown or other
  modified_base (244)..(244): a, c, t, g, unknown or other
  modified_base (306)..(306): a, c, t, g, unknown or other
  modified_base (404)..(404): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctggcgagaggccacatcaactgcaagtccagccanagtgtttanacagccctaanaataacaactacttaacttgatcagcaagaaattaggccagcctctaagcgactcatttccngggcatctacccgggaatcccgggggtccctgaccgattcgagtggcaggcgggtctgggacagatttcactctcaccatcagcagcctcagctgaantgtggctagtttagtactgtcagcaggatatgatatccgtgacgttcgcaaagggaccaaggtggaacttacgaaagacctgtaggctgcactaattctcg

SEQ ID NO: 434294 - DNA, 585 bp, Homo sapiens
  misc_feature: GZ8MTXP01D5RKB.39.29.C07.1.454.CMB.2.raw
  modified_base (240)..(240): a, c, t, g, unknown or other
  modified_base (254)..(254): a, c, t, g, unknown or other
  modified_base (314)..(314): a, c, t, g, unknown or other
  modified_base (340)..(340): a, c, t, g, unknown or other
  modified_base (367)..(367): a, c, t, g, unknown or other
  modified_base (429)..(429): a, c, t, g, unknown or other
  modified_base (434)..(434): a, c, t, g, unknown or other
  modified_base (559)..(559): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtggcgagagggccaccatcaactgacaagtccagccactagttgttttanacacgaccctaaanaataacaactaacttaactgatcagacaagaaatgccagccctacagctactctattcgnggacatccgaccggatcccgggtccngaccgtatcgagtcggcgaggcgggtntgggactagtactttccactctacaaccctatccaagccacggtcctaccgaggctagaagnttggngtaacttagttttactacgtgtaccgaggacaaggtcttaagttagtattacggttcggtacggtacggttaaccggacgaaacgggtaccgaaaggggttacgaacttaaccgaaagttaacgnggtaggcctgaccactaacttcgttc

SEQ ID NO: 434295 - DNA, 580 bp, Homo sapiens
  misc_feature: GZ8MTXP01CTG2P.39.29.C07.1.454.CMB.2.raw
  modified_base (239)..(239): a, c, t, g, unknown or other
  modified_base (252)..(252): a, c, t, g, unknown or other
  modified_base (274)..(274): a, c, t, g, unknown or other
  modified_base (314)..(314): a, c, t, g, unknown or other
  modified_base (384)..(384): a, c, t, g, unknown or other
  modified_base (410)..(410): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtggcgaggacggccaccatcaactgacaagtccagccatagttgtttanacagaccctaaanaataacaactacttaactgatnagacaagaaatcggccagcctacaagcactctacttccgnggactacgtccgtacccgggaagttcccggggtacctggaccgtacttcgaggtgcgacggtcgggttcngggactagtactttcacttcacactntcagcagtcctcgagactagaatgtgtgtacttaagtttattaacgtgtaccagagtaagtattagtagtattcgtcggtagtccgtcggaacgaagggaccttaaagggtacgaacttaaacgttaaacggttaccgtggtaaggtcctaggaccacctgttaacttcg

SEQ ID NO: 434296 - DNA, 707 bp, Homo sapiens
  misc_feature: GZ8MTXP01B5QLM.39.29.C07.1.454.CMB.2.raw
  modified_base (238)..(238): a, c, t, g, unknown or other
  modified_base (251)..(251): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccacagtgttttanacagaccctaaanaataacaactacttaactgatcagcaagaaatagccagcctacctaaagccgactcactttccgtgggactagtccgtaccccgggtaaattccccgggggtaccctcggaaccccgtatttccgaggttcggaccacgggccggggttcgtcggggggactaacggtacttttccgaacttccgtaccaccctattcgaacgccgacgtccctaccgaacgggtccttaaggaaacgtattagggtacggtaccgttaaggtttttaacttaacgttcgggttacaaacggtccgaaaggtattaagttacggtattaacggtttccggtaggttaccgggttaaccggaccggttaaacggggtacccgttaaaggggtaacgtaaacgttaaccgaaacggttaaaccgttgggtcgggtaacttcgacccgttaccgtaagttcttaacccg

SEQ ID NO: 434297 - DNA, 515 bp, Homo sapiens
  misc_feature: GZ8MTXP01AWBGV.39.29.C07.1.454.CMB.2.raw
  modified_base (233)..(233): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccaacagagtgtttanacagttccaacaataaaactcttagcttggcaccagcagaaaccaggacagcctctagagtgctcatttacgtgggcatcgtaccgggatccgggtcctgaccgattcagtgcagcgatcgtgggacagtatttcactctcaccatcagcagcctgcaggctagaagatgtgactagtttatactgtacaactaatattataactcctcctctagtaactttggcccgtaaggggaccaagtcttaggagactaacgaaacgtaactgaggctgcctaaccg

SEQ ID NO: 434298 - DNA, 562 bp, Homo sapiens
  misc_feature: GZ8MTXP01DIJ2V.39.29.C07.1.454.CMB.2.raw
  modified_base (239)..(239): a, c, t, g, unknown or other
  modified_base (253)..(253): a, c, t, g, unknown or other
  modified_base (319)..(319): a, c, t, g, unknown or other
  modified_base (374)..(374): a, c, t, g, unknown or other
  modified_base (394)..(394): a, c, t, g, unknown or other
  modified_base (423)..(423): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccactagtgttttanacacgaccctaaanaataacaactacttaacttgatcagcaagtaaataggccagccctacctaaagcgactcatttccngggcatcgtaacccgggaatcccggggtcctgaccgattcagtggcaggcgggtntggggacagtatttcactcncaaccatcagcacgcctcaggctagaagntgtggactagtttattactgtacagcaggattagttagattacttccggtgggtaccgtttcgggaccgttaaagggaccgaaagggtacggaacttaacgaaacgttaactggttagcgtacgcactaacgttcttcg

SEQ ID NO: 434299 - DNA, 547 bp, Homo sapiens
  misc_feature: GZ8MTXP01AT5CA.39.29.C07.1.454.CMB.2.raw
  modified_base (227)..(227): a, c, t, g, unknown or other
  modified_base (237)..(237): a, c, t, g, unknown or other
  modified_base (249)..(249): a, c, t, g, unknown or other
  modified_base (317)..(317): a, c, t, g, unknown or other
  modified_base (348)..(348): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccanagttgtttanacagccctaaanaataacaactacttaactggatcagcaagaaattaggccagccctacctaaagccgactctatttccngggcatccgtacccgggaatcccggggtccngaccgacttcgagtggcaggcgggtctgggacagtactttcactctacaccatcagcacgcctcgaggctagaagatggtggacttagtttacttacgtgtcagctagattagttgattgttccgtaggcgttcggacgaagggaccaagggtacgaacttacgaaacgacgtggtacgctgccactaacgttctaacg

SEQ ID NO: 434300 - DNA, 587 bp, Homo sapiens
  misc_feature: GZ8MTXP01EWL2M.39.29.C07.1.454.CMB.2.raw
  modified_base (237)..(237): a, c, t, g, unknown or other
  modified_base (251)..(251): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtatcgtgggcgagagggccaccatcaactgcaagtccagccacagtgtttanacacgaccctaaanaataacaactacttaactgtatcagcaagaaatcggaccagcctaccaagcactctatttcctgggctactccgtaacccgggagtcccgggtccctagaccgtactcgagtggacaggcgggtctgggactagtcttcgactctacaccatcagcacgccctacgaggctaggaagtagtcgaggtacttagtttactacgtggtacagcgtaaggtattagttagtacgttacgtccggtagtaccggttaacggacgaaagggaccgttaaaggacgtaacgttaacgaaacgttaacgtggtacggtctagaccttactaacttcgttaacg

SEQ ID NO: 434301 - DNA, 527 bp, Homo sapiens
  misc_feature: GZ8MTXP01CYDCO.39.29.C07.1.454.CMB.2.raw
  modified_base (226)..(226): a, c, t, g, unknown or other
  modified_base (236)..(236): a, c, t, g, unknown or other
  modified_base (248)..(248): a, c, t, g, unknown or other
  modified_base (311)..(311): a, c, t, g, unknown or other
  modified_base (361)..(361): a, c, t, g, unknown or other
  modified_base (367)..(367): a, c, t, g, unknown or other
  modified_base (407)..(407): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccanagttgtttanacagccctaaanaataacaactactaacttgatcagcaagaaattaggccagccctactaagcgactcatttccngggcatcgacccgggatccgggtcctgaccgattcagtgcaggcgggtcngggacngtattcactctcacatcagcacgcctcgagctgaagatgngactagtttatacgtgtacagcaggattattacgattacgttccggtggtacgttcgacgaaagggtaccaagggttagaacttacgaaacgacgtgaggctgacaccgtaattcgttcg

SEQ ID NO: 434302 - DNA, 579 bp, Homo sapiens
  misc_feature: GZ8MTXP01AUTYL.39.29.C07.1.454.CMB.2.raw
  modified_base (238)..(238): a, c, t, g, unknown or other
  modified_base (251)..(251): a, c, t, g, unknown or other
  modified_base (316)..(316): a, c, t, g, unknown or other
  modified_base (436)..(436): a, c, t, g, unknown or other
  modified_base (461)..(461): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccactagtgttttanacagaccctaaanaataacaactacttaactggatcagcaagaaattggccagcctacctaagccgactctatttccngggctatccgtaccgggaatccccgggggtccctggacccgtacttcaggtaggcgaggcgggtctgggacagtactttcactcgtacacccatcagcacgcctcgaagctagaagatgnggactagtttactacgtgtacacgngaagtatatttagattacgtccgtcggtacgttcgaccgttaaagggacccttaaagggttacgaaaccttacgaaaacgttacgtaaggtcgcttacgccacctaacttcgttaacg

SEQ ID NO: 434303 - DNA, 724 bp, Homo sapiens
  misc_feature: GZ8MTXP01BL7ON.39.29.C07.1.454.CMB.2.raw
  modified_base (239)..(239): a, c, t, g, unknown or other
  modified_base (253)..(253): a, c, t, g, unknown or other
  modified_base (320)..(320): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtggcgagacgggccacatcaactgcaagtccagccactagttgttttanacacgaccctaaanaataacaactacttaactggatcagcaagaattacggccagcctactaagcgtactctactttccgngggaccagttcccgtaacccggggtaattccccgggggtacctaggaccgtactttaccgaggttcggaccacgggtccggggttacgttcgggggaacctaagggttaacttttcccaaccgtttctacccgaaaccccgtaattcccgaacggtacccaaacgggtccccttacccggaaagggtccgttaagggaaacgtacgttgggttacgggtacttaacggtttttacttaacccgttggttaacgacggtacgtaaggtacttaagttagtacgttacgttacccgggtagggtaacccggttccgggaacgttaaacggggtacccgttaaagggtacggtaaccttacggaaacgttaaccgtggtacggctcgacgttacctaattcgttccg

SEQ ID NO: 434304 - DNA, 676 bp, Homo sapiens
  misc_feature: GZ8MTXP01D1227.39.29.C07.1.454.CMB.2.raw
  modified_base (240)..(240): a, c, t, g, unknown or other
  modified_base (254)..(254): a, c, t, g, unknown or other
  modified_base (329)..(329): a, c, t, g, unknown or other
  modified_base (372)..(372): a, c, t, g, unknown or other
  modified_base (410)..(410): a, c, t, g, unknown or other
  modified_base (472)..(472): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccatagttgtttanacacgaccctaaanaataacaacttacttaactggtatacagacaaagtaaatcggaccagccctacctaagcctactctactttccgngggacctacgtccggtaaccccggggagttccccgggggtccnggacccgtattccgaggtcggaccagggtccgggttcnggggactagtactttccacctctacaaccatcaacgcacgccctacgaggtactagaaagtntacggtggtacttagttttaacttacgtgtaccgagtacgtaaggtatttagttaaggtatttacggttcccggtagggtaaccccggttcgggaaacccggttaaacgggggtaacccgttaaaggggtaaccgggtaaaccttaaaccgaaacggttaaacgtgggtacggtcctacggacccttaacctgtttcccgttcg

SEQ ID NO: 434305 - DNA, 723 bp, Homo sapiens
  misc_feature: GZ8MTXP01DCOUI.39.29.C07.1.454.CMB.2.raw
  modified_base (242)..(242): a, c, t, g, unknown or other
  modified_base (328)..(328): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgacaagtccagccactagttgtttanacacgaccctaaacaataacaactacttaactggtatcagcaagaaattacggccagccctacctaagccgtactctactttccgngggacctacgttacccgaaccccggggtaacgttccccgggggtacccctggtaaccccgtattccgaggtcggacacgggtccgggttcgtgggaacaggttactttccaaccttccgtaccaaccctataccgacgaccaccgtcccctacccgaaggtcctaggaaacgtgtaggtcggtactttaaaggttttattaaccgtggttaccaggtacaaggtattagttagtaacttcgttccgggtacgggtaaccgggtttccgggaaccgttaaacgggggtaacccgaaaggggttaaccggtaaaccgttaaaccgttaaaaccgggttaccgttggggtaaccggtccgttacggacccttaaccgtaacgttccggttttaacccg

SEQ ID NO: 434306 - DNA, 638 bp, Homo sapiens
  misc_feature: GZ8MTXP01CQ4B3.39.29.C07.1.454.CMB.2.raw
  modified_base (258)..(258): a, c, t, g, unknown or other
  modified_base (330)..(330): a, c, t, g, unknown or other
  modified_base (466)..(466): a, c, t, g, unknown or other
  modified_base (471)..(471): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtcctccagacctccctggctgtgtctcgtgggcgaggacgggccaccatcaactgacaagtccagccactagttgtttacacacgaccctaaanaaataacaacttacttaacttgatcagacaagaaatcggaccagccctacctaagcgtactctactttccgngggaccagttcccgacccggggtacgtccccgggggtccctaggaccgtattcgaggtcggacgaggcggggttctggggaactagtactttccactctaccacctatcacgcacgccctacgaggtctagaacgngttgnggtacttagtttaacttacgtgtaccaggtacgtaaggtattagttagtacttacggttaccggtcgggtaaccggttaacggaccggaaagggtacccggaaagggtacggtaacttacggaaaacggacgttgggacgtcctcggaccttaccgtaattcgttcg

SEQ ID NO: 434307 - DNA, 696 bp, Homo sapiens
  misc_feature: GZ8MTXP01A9AAR.39.29.C07.1.454.CMB.2.raw
  modified_base (237)..(237): a, c, t, g, unknown or other
  modified_base (250)..(250): a, c, t, g, unknown or other
  modified_base (273)..(273): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccactagtgtttanacagaccctaaanaataacaactactaactgatcancaagaattacggccacgtcccctaacgtacgactactacttacttcggcgtactaccgttacccggtaaccggtaccgggttcccggtacgtaccgtacgttaccgtacggtacggtcgacgtcgggtccgggttcggaacggtaacgtactttacttacctactccgacctacacgtacacgacgacccgtccgtacggacgtcgtaaggaacgttgtggtaccgtacgtttaagttttaaccgtacgttacgacgtaacgtacgtaagttatttacggtacgtttaccggttccggttacggtaccggttccgggtaaccgaacgggttaaacggtaaacggttaacggtaaaccgaacgttaaaccgttaacgttcgtaagggccgtaaccgtacgtacccttacgttcgttaacgttcg

SEQ ID NO: 434308 - DNA, 532 bp, Homo sapiens
  misc_feature: GZ8MTXP01A0OCZ.39.29.C07.1.454.CMB.2.raw
  modified_base (247)..(247): a, c, t, g, unknown or other
  modified_base (311)..(311): a, c, t, g, unknown or other
  modified_base (424)..(424): a, c, t, g, unknown or other
  modified_base (464)..(464): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccacatcaactgcaagtccagccacagtgtttatacagaccctaaanaataacaactactaacttgatcagcaagaaattaggccagccctactaagcgactctactttcngggcatccgtacccgggaatcccgggggtcctgaccgtacttcgagtggcaggcgggtctggggacaggtatttccactctacacctatcagcacgcctcaaggctagaaagntgtgctagtttatctgtcagcaggtatattgatacgtcgngtcgtcggacgaagggacagggtcgaacttacgaaacgttacgtggcgctgaccttactcgttcgtcg

SEQ ID NO: 434309 - DNA, 545 bp, Homo sapiens
  misc_feature: GZ8MTXP01DNRSC.39.29.C07.1.454.CMB.2.raw
  modified_base (242)..(242): a, c, t, g, unknown or other
  modified_base (255)..(255): a, c, t, g, unknown or other
  modified_base (319)..(319): a, c, t, g, unknown or other
  modified_base (450)..(450): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggaggcccacatcaactgacaacgtccagccactagttgtttanacacaccctaaanaataacaacttacttaacttggatcagcaaagtaaattcggccagcctacaagcactcattcgnggcatcgtaccggatcccgggtcctgaccgtatcgagtgcaggcgggtctgggactagtacttcgactctacacatcaagcacgtcctcgagtctagaagactgtgactaagtttatactgtcagcaagtnttatcgattcgtccgtaggtcgtaacggacgaagggacaaggggtataacaacgaaacggttaatggtggctacgcttaccgtaattcgttaacg

SEQ ID NO: 434310 - DNA, 698 bp, Homo sapiens
  misc_feature: GZ8MTXP01DBWXU.39.29.C07.1.454.CMB.2.raw
  modified_base (242)..(242): a, c, t, g, unknown or other
  modified_base (255)..(255): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatccaactgaccaagtccagccacagttgttttanacagaccctaaanaactaacaacttacttaactgtatcagacaagtaaattacggacccagaccctacctaaagccgtactctatttccgagggctacgttaccgtaacccgggggaacgttccccgggggtaccctggacccgtacttccgaggtcggaccgacggtccgggggttactcgggggaactaggtactttccgaacctctaccacctatcacggccacgcccgtaccgaggctaggaagtagtacgtaggtacttaagtttacgttacgtgttacagtacgaggtattagttagtaacttacgttccgggtacggttaacggttaaccgggaaccggttaaacggggtaacccgaaaggggttaacggaaaccgttaaacggaaaaccgttaacggttcgggtacgggtaacctacggacccttaccgtaacgttccgtttaaccgg

SEQ ID NO: 434311 - DNA, 670 bp, Homo sapiens
  misc_feature: GZ8MTXP01DF97B.39.29.C07.1.454.CMB.2.raw
  modified_base (308)..(308): a, c, t, g, unknown or other
  modified_base (321)..(321): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccagtagttgtttacacaggtaccaaacaataagaattactcgctaggaccagcaaagaaccaggacacgcctactaagttnctctaatttacgngggactacgttaccgacccgggggtacggttccccgggggtaccctggaaccccgtagttccgaacgggtccgggacctacggggtcccggggttactaacgggacgtaaccaaggttactttccgaccttctacccacctatcacgcacgccctacgacgactaggaaagtacgtggtagggtaccttaagggttttacttccgtagtaccagtaccgtaggtattaagttgtattacgttccggtagggaaccgtttaccgggaccgtaaacggggaccgtaaaggggttacgaaacttacggaaaacgtaagtcgttcggacgtacgaccctaacgttaacgttcg

SEQ ID NO: 434312 - DNA, 600 bp, Homo sapiens
  misc_feature: GZ8MTXP01DGMCL.39.29.C07.1.454.CMB.2.raw
  modified_base (240)..(240): a, c, t, g, unknown or other
  modified_base (324)..(324): a, c, t, g, unknown or other
  modified_base (427)..(427): a, c, t, g, unknown or other
  modified_base (494)..(494): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccacagttgtttaanacacgaccctaaacaataaacaacttacttaacttggatcagacaaagaaatacggccagccctacaagcgactcactttccgnggctatccgaaccgggtactccgggtcctgaccgtatcagtgcacggcggtctgggacagtacttcactctacaccatcagcacgcctacgaggctagaaacngtgtcggtacttaagtttattacgttagtaccaggacaaggtattagttacgattaacggttccggnggtacgttaacgggaaccgaagggtaacccgaaagggtaacgaaccttaacgaaaacggttaacgttcggtacgggtcctacgacgttaacctaacgttcttaacg

SEQ ID NO: 434313 - DNA, 710 bp, Homo sapiens
  misc_feature: GZ8MTXP01CR2OS.39.29.C07.1.454.CMB.2.raw
  modified_base (686)..(686): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccactagttgttttaacacacgaccctaaacaataactaacttaacttaacttggtatacagacaagtaaaattcggaccaagtccctaccgtaaacgccgtactctacttttccgaggggtactaacgttcccgaaccccgggggtaacgttccccgggggtacccctaggtaacccgtatttccggaaggtgggaccacggtccggttgtcgtaggggactaggttatttccgaccttctaccaacctactcgacgtcaccgtcccgtacgaacggctaggaaagtagtggtacggtacttaaggttttacgttaacgtcgtacgagtacgaggttattagttagtaacgttacgtttaccgggtgggttaaccggttaccgggaccgggtaaacggggttaacccgtaaaacggggtcgaaaaccgttaccgaaaaaccggtgtacggtaacgggtnaccggacctaaccgttcgttaacg

SEQ ID NO: 434314 - DNA, 586 bp, Homo sapiens
  misc_feature: GZ8MTXP01DGGBL.39.29.C07.1.454.CMB.2.raw
  modified_base (241)..(241): a, c, t, g, unknown or other
  modified_base (254)..(254): a, c, t, g, unknown or other
  modified_base (317)..(317): a, c, t, g, unknown or other
  modified_base (370)..(370): a, c, t, g, unknown or other
  modified_base (459)..(459): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatacaactgcaagtccagccacagttgtttaanacagaccctaaanaataacaactacttaactgatcagcaagaattagccagccctactaaagcactctatttccgnggcatccgtacccgggatcccggggtcctgacctacttcagtgcaggcgggtntgggacagtactttcactctacaccatcgagcacgccctacgaggtctagaagtagtcggtagtctaagttttacgtacgtgtaccagntaaggtattagttagattacgttcggtacggtacgttccggaacgaacggggaaccgaaagggtagaaacccttaagttaaaaccggacgttgggacggtctacggacaccgtaacgttcttaaccg

SEQ ID NO: 434315 - DNA, 627 bp, Homo sapiens
  misc_feature: GZ8MTXP01DNAUT.39.29.C07.1.454.CMB.2.raw
  modified_base (241)..(241): a, c, t, g, unknown or other
tcagtcgcactagtcacgaccggtgctcgatttagagtgctacgaagggaaaggggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtacagccactagtgttttanacacgccctaaacaataacaacttacttaacttggaatcagcaagaaagttacggccagccctaccgtaagccgtactactacgtttcccgtggggacctacgttcccgtaaccccgggggtaaacgttccccgggggtacccctggacccgtaactttccgaggtcggccgaggggtcccggggtactcgggggactaaggtactttccgactcctacaccatcacgcacgcctccgaggctagaagatgtggactagtttattacgtgtacagcgtaggtattagtagtattacgttccggtgggtacgttaacggaccgaaagggaccgaagggtacgtaacttacgaaacgttacgtggtacgctcgacacctgttcgttcg

SEQ ID NO: 434316 - DNA, 578 bp, Homo sapiens
  misc_feature: GZ8MTXP01BNGH0.39.29.C07.1.454.CMB.2.raw
  modified_base (228)..(228): a, c, t, g, unknown or other
  modified_base (238)..(238): a, c, t, g, unknown or other
  modified_base (252)..(252): a, c, t, g, unknown or other
  modified_base (423)..(423): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgacaagtccagccanagttgtttanacacgaccctaaanaataacaactactaactgatcagcaagaatgccagcctactaagccgactctatttcctgggacactccgtaaccgggatcccgggtcctgaccgtattcgagtgcaggcgggtctgggactagtacttcactctacaccctatacagcacgtccctcgaaggctagaagntgtgtacttagtttactaacgtggtacagacgtaggtattagttagacttacgttccggtacggtacggttccggaaccgttaaaggggaccgttaaagggtacggtaaacttaacgaaaacgacgtggtcggcttacgaccactaagttccgtg

SEQ ID NO: 434317 - DNA, 603 bp, Homo sapiens
  misc_feature: GZ8MTXP01COO2I.39.29.C07.1.454.CMB.2.raw
  modified_base (237)..(237): a, c, t, g, unknown or other
  modified_base (243)..(243): a, c, t, g, unknown or other
  modified_base (257)..(257): a, c, t, g, unknown or other
  modified_base (321)..(321): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggcccaccatcaactgacaacgtccagccactagttntttaanacacgaccctaaanaataacaactacttaacttgatcagcaagaatggccagcctacctaagcgaactctatttccgnggcaagtccgaacccgggatcccgggggtaccctgaccgtattcgagtcggcaggcgggttctggggactaggtactttccaactctacaacccatcacgcagccctccgaggcctagaagtagtgtgtactaagtttacttaactggtacaacgtactaggtaattgttagacttacgttcccggtagggtaccgttaaccgggaaccgttaaagggaccaagggtaaacggtaacacgaaaacgaacgttggaggtctaggcaaacccgttgttcgtaag

SEQ ID NO: 434318 - DNA, 662 bp, Homo sapiens
  misc_feature: GZ8MTXP01A9IY4.39.29.C07.1.454.CMB.2.raw
  modified_base (243)..(243): a, c, t, g, unknown or other
  modified_base (257)..(257): a, c, t, g, unknown or other
  modified_base (330)..(330): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgaggacggccaccatcaactgacaagtccagccactagttgtttanacacgaccctaaanaataacaactacttaacttggatcagacaagtaaagtcggaccagccctacctaagcgtactctactttccgngggactacgtccggtaacccgggtaacgttccccgggggtcctaggacccgtacttccgaggtcggcgaggtccggggtcgtgggggactaaggtactttccaccgttcctaccaacctactcgaacgccacgtccctacgaacgggctaggaagtacgtggtcggtacttaagtttattacgtgtacgagtacgaagtattagttagtaacgttacgttcggtacggtaccggttaaccggaacggttaaacgggtaaccgttaaagggtaacgtaaacgttaacgaaacgttacgttcggtagtctacggaccttacgtaactttcgtcg

SEQ ID NO: 434319 - DNA, 683 bp, Homo sapiens
  misc_feature: GZ8MTXP01DFHPG.39.29.C07.1.454.CMB.2.raw
  modified_base (230)..(230): a, c, t, g, unknown or other
  modified_base (240)..(240): a, c, t, g, unknown or other
  modified_base (254)..(254): a, c, t, g, unknown or other
  modified_base (332)..(332): a, c, t, g, unknown or other
  modified_base (376)..(376): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccanagttgtttanacacgaccctaaanaataacaactacttaactgatcagacaagtaaattacggccaagtcccctaccgtaaagccgtaactctactttccgngggactacgttccgaaccccgggggtaatccccgggggtacccngacccgtattccgaggtcggcgagggtccggggttctggggaactagtactttcacctctaccacgactcagccacgccctaccgaggtcgtaagaagagttggtacgtacttaagttttagttacctggtacaacggtgaaggtattaagttgtaacttcggtttaccggacggtcccggtttaacgggaaccgttaaaagggggaaccccgttaaaggggtttaacgaaaccgttaccgaaaaccggttaaacgttcgggtaacggtcccgttacgacccgttaacccttaagtttccggttccg

SEQ ID NO: 434320 - DNA, 797 bp, Homo sapiens
  misc_feature: GZ8MTXP01ERSGA.39.29.C07.1.454.CMB.2.raw
  modified_base (240)..(240): a, c, t, g, unknown or other
  modified_base (254)..(254): a, c, t, g, unknown or other
  modified_base (320)..(320): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtggcgagacgggccacatcaactgacaagtccagccatagttagtttanacacgaccctaaanaataacaactacttaactgatcagacaagaatacggccagccctactaagctactctactttccgnggtactacgttacccggtaacccggggtacgttccccgggggtaccctacggtacccgtacgttaccggtagggtcgggacccgtaacgggggtcccgggggttacccgttaaggggggaaaccctaaacgggttacctttttaccccgaacccgtttcccgtacccgtaaaccctacgttacccgaaacggtcccgaaccggtcccccttaacggaaacgggtccttaaagggaaacgtagttcgggtacggtacgttaacggttttaacgttaccgttggtaccgtaaggacgtaagggtaatttagttaacgtagttaccggtttacccgggtagggtaacccggttaaccgggaaaccggttaaacgggggtaaaccccgttaaagggttaccggaaaaccgttaaccgttaaaacggttaccgttgggtaacggtcccgttacggaccgttaacctcgtttccgtttaaccg

SEQ ID NO: 434321 - DNA, 563 bp, Homo sapiens
  misc_feature: GZ8MTXP01A4AFO.39.29.C07.1.454.CMB.2.raw
  modified_base (238)..(238): a, c, t, g, unknown or other
  modified_base (272)..(272): a, c, t, g, unknown or other
  modified_base (312)..(312): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactacaagtccagccacagttgttttanacagccctaacaataacaactacttaactggtancagcagaaattaggccagcctcctaagcgactcatttccngggcatccgtacccgggaatcccgggggtccctgaccgattcccaggtggcaggcgggtactgggaacaggtactttcactctacaacctatccagcacgccctccgagctagaagtatttgactagtttattactggtacaaatacgtaacaagttcgacgtcggccttctccgtacgtttcgggacggaaggaccgagggtggagagtacgaaacgttacgttggtgctcgcaccgttatcgttgttcc

SEQ ID NO: 434322 - DNA, 738 bp, Homo sapiens
  misc_feature: GZ8MTXP01EA9HM.39.29.C07.1.454.CMB.2.raw
  modified_base (243)..(243): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggccaccatcaactgacaagtccagccactagttgtttanacacgtaccctaaacaataaacaactaacttaacttggtatacagacaaagtaaagttacggacccacgtaccctacctaaacgccgtacttactactttccgtgggactacgtcccgtaacccggggtaacgttccccgggggtaccctacggaacccgtacgttaccgaggtcggaccgacggggtccggggtcgtaacgggggactaagttactttcccgaacttccctacaaccctatcgaacgccgaacgtccccgtacgacgggtacctagggtaaagtagttacggtaggtaccgtttaaggttttaaccgtttacgttacggttaccgaaggtaccgtaagggttattacggtttagtacgttaacgttccgggttaacgggtccggttaacggaccggaaagggtaacccgttaaagggtaccgaaacgttaccgaaacggttaacgtcgggtcggtaacgtcggaccttactaacgttcgttccg

SEQ ID NO: 434323 - DNA, 617 bp, Homo sapiens
  misc_feature: GZ8MTXP01EZIOF.39.29.C07.1.454.CMB.2.raw
  modified_base (244)..(244): a, c, t, g, unknown or other
  modified_base (258)..(258): a, c, t, g, unknown or other
  modified_base (327)..(327): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggcttgtgtctcgtgggcgagacgggcccaccatcaactgacaagtccagccactagttgttttanacacgaccctaaanaataacaactacttaacttggatcagacaaagtaaattacggccacgcctactaagccactcatttcgngggactacgtccgtaaccgggacttcccgggtacctgaccgtattccgaggtcggacacggtcgggtcgtcgggaactaggtactttccacttcgtacaccatcagcacgtcctacgacggctagaagtgtgagtactagtttactacgttggtacacggataaggtattagttatagttacgttaccggtgggtaacgttccggggaacgttaaacggggaccttaagggtacggtaaacttaacgaaacggttaccgtggtcgctacgaccacgtaacttcgttaacg

SEQ ID NO: 434324 - DNA, 572 bp, Homo sapiens
  misc_feature: GZ8MTXP01BW7ZA.39.29.C07.1.454.CMB.2.raw
  modified_base (240)..(240): a, c, t, g, unknown or other
  modified_base (254)..(254): a, c, t, g, unknown or other
  modified_base (274)..(274): a, c, t, g, unknown or other
  modified_base (310)..(310): a, c, t, g, unknown or other
  modified_base (390)..(390): a, c, t, g, unknown or other
  modified_base (400)..(400): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgacaagtccagccactagttgttttanacacgaccctaaanaataacaactactaactgancagcaagaatagccagcctactagcactcattccgngggactacgtccgtacccgggatcccggggtcctgaccgtattcgaggtgaccgaggcgggtcgtgggactagtattccnctctacaccntcagcacgcctcgacggctagaagtatgtgacttagtttatacgtgtacgaggtctaaggtattagtagtacttagttacccggtggtacggttcggaccgaaagggtaccaaagggtacggaacttacgaaacgttacgtggtcggaactgacttacctaagttcttaacg

SEQ ID NO: 434325 - DNA, 645 bp, Homo sapiens
  misc_feature: GZ8MTXP01DJ20U.39.29.C07.1.454.CMB.2.raw
  modified_base (242)..(242): a, c, t, g, unknown or other
  modified_base (255)..(255): a, c, t, g, unknown or other
  modified_base (440)..(440): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccactagttgttttanacagaccctaaanaataacaacttacttaacttggtatcagacaaagtaaattacggccagcctacctaagcctactctactttccgtgggactacttccgtacccggggtaacgttccccgggggtccctacgacccgtattccgaggtcggacgtaggccggggtcgtggggaactagtactttccactctacacntcgagcacgccctacgaggtctaggaagtagtggtaggtacttagtttattacgtgtacagacgtaaggtattagttagtagttacgttccggtaggtaccggttcggaaccggaaacggggtaaccgttaaagggtaacggtaaccgttaaacgaaacgttaacgtggtacggtctcggaccttacctaacgttcgtttaaccg

SEQ ID NO: 434326 - DNA, 601 bp, Homo sapiens
  misc_feature: GZ8MTXP01CW16I.39.29.C07.1.454.CMB.2.raw
  modified_base (241)..(241): a, c, t, g, unknown or other
  modified_base (255)..(255): a, c, t, g, unknown or other
  modified_base (276)..(276): a, c, t, g, unknown or other
  modified_base (314)..(314): a, c, t, g, unknown or other
  modified_base (450)..(450): a, c, t, g, unknown or other
  modified_base (456)..(456): a, c, t, g, unknown or other
  modified_base (477)..(477): a, c, t, g, unknown or other
  modified_base (487)..(487): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccactagttgtttanacagtaccctaaanaataacaactacttaactgancagcaagaatcgccagcctacagcgactctactttcgnggactacgtccgtaacccgggtagtcccgggtacctgacccgtattccgaggtcggacgacgggtccgggtacgtgggaacagtactttccaactctacaccctatcgaatcacgccctacgaggtctagaaacgngttggnggttacttaaggtttactacnggtacagtanaggtattagtacgattacgtccggaggtaccgttaacggacgaaagggtaccaagggttaacgaaccttaacgaaacgttacgtggtacgcgttacgcaacctgttcgttaacg

SEQ ID NO: 434327 - DNA, 609 bp, Homo sapiens
  misc_feature: GZ8MTXP01CDRDP.39.29.C07.1.454.CMB.2.raw
  modified_base (238)..(238): a, c, t, g, unknown or other
  modified_base (251)..(251): a, c, t, g, unknown or other
  modified_base (315)..(315): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccactagtgtttanacagaccctaaanaataacaactacttaactggatcagacaagaaattaggccagcctacctaagcactcatttccngggcatccgtaccgggagtcccgggtcctgaccgtacttcgagtggcaggcgggtctgggacagtattcactctcacatcagcacgcctacgaggtctagaagatgtggtacttagttttatacgttgtaccagtactaaggtattagttagtattacggttccggtggtaaccggtttaaccgggaacccggttaaaggggtaacccgttaaaggggttacggaaacttaaccgaaaacgggttaacttgggtacggaaccttcgggaccttaccgtaactttccgttaaccg

SEQ ID NO: 434328 - DNA, 699 bp, Homo sapiens
  misc_feature: GZ8MTXP01BZDPJ.39.29.C07.1.454.CMB.2.raw
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagttgtttatacagaccctaaacaataaacaactacttaacttgatcagcaagaaatggccagcctaccaagcgactctactttccgtgggcacttccgtaaccccgggacgttcccgggggtccctaggacccgtacttcgaggtcggccgaggtccggggttctggggactaggtacttttccaccttctcaacccgtatcgacggcaacggcccttacccgaagggcctaggaaagagttcgggtggaccgttaggttttacttacgttggttccaacggtcgtaaagggtatttaagttaggtaactttacgttacccgggttacgggttaaccggtttaacgggaacccgaaacgggggtaaccccgttaaagggggttaccggtaaacccgttaaaccggaaaaccggttaacgttcgggtagggtcccgttaggacccttaacccgtaagttcccgttttaacgg

SEQ ID NO: 434329 - DNA, 705 bp, Homo sapiens
  misc_feature: GZ8MTXP01BM89T.39.29.C07.1.454.CMB.2.raw
  modified_base (238)..(238): a, c, t, g, unknown or other
  modified_base (252)..(252): a, c, t, g, unknown or other
  modified_base (330)..(330): a, c, t, g, unknown or other
  modified_base (424)..(424): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagactccctggctgtgtctcgtggcgagacggccacatcaactgcaagtccagccactgttgttttanacacgaccctaaanaataacaactaacttaacttggatcagacaagtaaattacggccagtccctaccgtaagccgtactactactttccgngggcctacttaccggtaccccgggaagtccccggggtccctggaccgtacttcgaggtcggcaggcgggtctggggactagtactttcacttcncaactatcacgcacgccacgacggctagaaacgtgtggtacgtacgttaacgttttacttacgtcggtaccgaagtacgtaagggtatttaaggttacgttacgtttaccggtttacccggggttacggggacccggtttaacccgggggaaccccggttaaaggggggtaaaccccgttaaaggggtttaacccgggaaaccgttaaccggttaaaacccgttaagggttcgggtacggtcccgtaggtaaccccttacgtaaccgttttccgtttccgg

SEQ ID NO: 434330 - DNA, 728 bp, Homo sapiens
  misc_feature: GZ8MTXP01EJFAW.39.29.C07.1.454.CMB.2.raw
  modified_base (246)..(246): a, c, t, g, unknown or other
  modified_base (261)..(261): a, c, t, g, unknown or other
  modified_base (489)..(489): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctgatgccgtacggggacatcgtgatcgacccagtctccagacctccctggctgtgtctcgtgggcgagacggccaccatcaactgacaacgtccagccactagttgttttaanacgacgaccctaaanaactaaactaactacttaactgaactacagacaagtaaactcggaccacgcctaccaagccgtacttctaacgttttccgagggcctaacgttacccggtaaccccgggtaaacgttccccgggggtaccctacggtaacccccgtactttcggaaggtcggacgtaaacgggtccgggttcgacggggtaactacggtacttttccactctacacccatacagaccngtacccctaccgaaggtctaaggtaacgacgttggtcggtaacctttaggggtttttaaacttccgtagtaccgaaggtacgtaagggttaattacggttaggtaactttacggttccccgggttaagggtaaccgttcggaaaccgggtaaacgggttaacgtaaacggggttacgaaaacgttaccgggaaaacgtaacggtgggtcttacggacgttacctcccgttaatttcccg

SEQ ID NO: 434331 - DNA, 675 bp, Homo sapiens
  misc_feature: GZ8MTXP01D5DT6.39.29.C07.1.454.CMB.2.raw
  modified_base (243)..(243): a, c, t, g, unknown or other
  modified_base (257)..(257): a, c, t, g, unknown or other
  modified_base (278)..(278): a, c, t, g, unknown or other
  modified_base (320)..(320): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgaggacgggccacatcaactgacaagtccagccactagttatttanacacgaccctaaanaataacaacttactaactgancagacaagtaatacgccagccctactaagcactctatttcgnggcactaccgtaccggaacgtcccgggtccacgaccgtattcgagtcggacaggtcgggtctaaggggactacgttactttccaccgttctacgaacctatcgacgaccgacgtccctacggaacggtcgtaaggaaagtacgttgtaacggtatttaagttttacttacgtagtaccaaggtacgaaggttattagtttagtaacgtttaccgttaccggtacgggtacccggtttaaccgggaaccggttaaacgggggtaacccgttaaaggggtaaaccgtaaaaccttaacggaaaaccgttaaccggttgggtacgccgttcgaccttaccgtaattcccggtttaacg

SEQ ID NO: 434332 - DNA, 624 bp, Homo sapiens
  misc_feature: GZ8MTXP01ENXFY.39.29.C07.1.454.CMB.2.raw
  modified_base (241)..(241): a, c, t, g, unknown or other
  modified_base (254)..(254): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaagtccagccactagttgtttanacacaccctaaanaataacaactacttaactgatcagacaagtaaatacggaccacgtaccctacgtaagcgtactctactttccgagggactacgttacccggtaacccggggtacgttccccgggggtacctacggaccgtacttcgaggtggcgacgggtcgggtcgtgggactagtacttcactcacacatcacgcacgcctacgaggctaggaacgtgtcggtgtacttaagtttagttacgtgtacaggacgtaggtattagttagtacgttacggttccgggtaggtaccggttccggaacggaaacgggaccgttaaggtaacggaacttaacgaacgttacgtggtcgctacgaccttacgtaacttcgtaacg

SEQ ID NO: 434333 - DNA, 726 bp, Homo sapiens
  misc_feature: GZ8MTXP01EOHX6.39.29.C07.1.454.CMB.2.raw
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgaccagtctccagactcctggctgtgtctcgtggcgaggaggccacatcaactgacaagtccagccacgtagttgtttacacacgaccctaaacaaataactaactaacttaattgtatacagacaagtaaagttacgccacgaccctacgtaagcctactctacgtttccgagggactaccgttaccggtaccccgggtacgtccccgggggtaccctcggaccgtattccgaggtcgggacacggggtcgggttcgtaaggggaactaggtactttccaccgttccacctaacctatacgacgacctacgtaccccgtacgaacggtctaaggaaggtacgtacggtcgggtaactttaggttttaaactacggttaggtaacgtacgtaacgtaaggttatttacggttaagttacgttaaccgtttaccgggggtacgtaaccggggttcccggaaacgggttaaaccggggtaccgttaaaagggtacgggtaaaaccttaaccggttaaaacgttaggtcgggttacggaactccgaacttaacctcgttttaaccggtccg

SEQ ID NO: 434334 - DNA, 632 bp, Homo sapiens
  misc_feature: GZ8MTXP01BBK1O.39.29.C07.1.454.CMB.2.raw
  modified_base (251)..(251): a, c, t, g, unknown or other
  modified_base (266)..(266): a, c, t, g, unknown or other
  modified_base (545)..(545): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggcccaccataccaactgacaaagtacacgccactagttagttttaanacacgtaccctaaanaaataacaacttacttaacttggatcagacaaagtaaatacggcctagccctaccgtaagccactctacgtttccgagggactaacttccggtaacccggggtacgtccccgggggtccctaggacccgtattccgaggtcggacagggtccgggtgtcggggactagtactttccactctacaccagtcacgcacgtccctacgaacggcttaaggaagtgtagtcggtaacttagttttaacttacgtgtaccgaggactaaggttatagttacgtnttacgtccggtacgggtcgtcggaaccgttagggaccgaaggtaccgaacttacgaaacgcgtggtacgctgaccttactgttcgtg

SEQ ID NO: 434335 - DNA, 675 bp, Homo sapiens
  misc_feature: GZ8MTXP01A551D.39.29.C07.1.454.CMB.2.raw
  modified_base (239)..(239): a, c, t, g, unknown or other
  modified_base (661)..(661): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacagggacatcgtgatgacccagtctccagactccctggctgtgtctcgtgggcgagagggccaccatcaactgcaagtccagccactagttgtttanacacgaccctaaacaataacaactacttaactggtatacagacaagtaaattaggccagcctacctaaagccgtactctaactttccgtgggaccaacgttccggtaaaccccggggtaacgttccccgggggtcccttacggaacccccgtaacttcgaaggtcggaccgtaagggtccgggtcgtacgggggacctaagggtaaccttttccaaccttcttaccaaccctacttaccgacgggaccaccggtccctacccgaggggtcttaacgggaataacgtgggtacggccttaagggttttaaacttccgtagtacgaagcgtaggaattatgtaacttacgttcccggagggtccgttcggacccgtaaagggaccgtaagggtacgaacttacgaaacgtaacgtgtcgacgtnacaacgaacgtttc

SEQ ID NO: 434336 - DNA, 794 bp, Homo sapiens
  misc_feature: GZ8MTXP01AGM6W.39.29.C07.1.454.CMB.2.raw
  modified_base (241)..(241): a, c, t, g, unknown or other
  modified_base (256)..(256): a, c, t, g, unknown or other
  modified_base (339)..(339): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacggccacatcaactgacaagtccagccatagttgtttanacacgtaccctaaanaataactaacttacttaacttggactcagacaagtaaacgttcggaccagccctaccgtaaagccgtactctacttttccggnggggacctacgttacccggtaacccgggggtacgttccccggggggtacccctacgggtaaccccgtagtttaccgaggggttacgggacccggaggggtcccgggggttacgttggggggaaactaacgggttacttttacccgacccgttctaccgtaaaccctatacccgacggtaccgaacggtccccttaccggaacgggtaccgtaagtaaacggtggttacggtagggtaacctttaagggttttaaacttaccgttaggtaaccgaggtaaccgtaagggttaattagtttaacggtaacgttttaaccggttcccgggtaagggtacccgggtttaaccggggaaccgttaaacgggggtaaccgttaagggtaacggtaaacccgaacgttaaacggttaaccgttgggttacggcgtaccggaccttaccgtcttaacgtttcg

SEQ ID NO: 434337 - DNA, 663 bp, Homo sapiens
  misc_feature: GZ8MTXP01DG19F.39.29.C07.1.454.CMB.2.raw
  modified_base (242)..(242): a, c, t, g, unknown or other
  modified_base (256)..(256): a, c, t, g, unknown or other
  modified_base (324)..(324): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgcaacgtccagccactagttgtttanacacgaccctaaanaataacaactacttaactgatcagacaagaaattacggaccagccctactaagcactctactttccgngggactacgtacccgtaccccgggggtaacgttccccgggggtacctacggtaccgtacttccgaggtcggacgacggtcgggtcgtggggactagtactttaccacctacctacctaacccgatccagaccacgccctaccgagacgtagaacgagtgtggtacttagtttaacggttctgtacgacgataaggtattagttagtacttacgtcccggtaggtaccggttaacgggaaccgaaacggggtaaccgaacgggtaaacggtaaaccttaaccgaaaacggttaaccgttgggtaccggtaacgtcgaccgaactaacgtttcgttaaccg

SEQ ID NO: 434338 - DNA, 551 bp, Homo sapiens
  misc_feature: GZ8MTXP01AJTZO.39.29.C07.1.454.CMB.2.raw
  modified_base (235)..(235): a, c, t, g, unknown or other
  modified_base (325)..(325): a, c, t, g, unknown or other
  modified_base (358)..(358): a, c, t, g, unknown or other
  modified_base (376)..(376): a, c, t, g, unknown or other
  modified_base (390)..(390): a, c, t, g, unknown or other
  modified_base (422)..(422): a, c, t, g, unknown or other
  modified_base (427)..(427): a, c, t, g, unknown or other
  modified_base (442)..(442): a, c, t, g, unknown or other
  modified_base (534)..(534): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctgatgcctacggggacatcgtgatcgacccagtctccagacctccctggctgtgtctcgtgggcgagacggccacatcaactgcaagtccagccactagttntttaacacacgaccctaaacaataacaacttacttaactgatcagcaagtaaatcggccagccctaccgaagccgtactctagtttccgnggcagtccgtaccgggatccgggcctgaccctntcgagtgcaaggcgggtntgggacagtcttcnctcacacatcagcacgcctcgaggtcagaagngttgngtacttaagggtttntacgtgtacagcaggtattagtgtacttagtccggtggtaaccgtcggacgtaacggacgaaggttacgacaacgaaacgtgtggtcgtacncgactccttaagttccg

SEQ ID NO: 434339 - DNA, 627 bp, Homo sapiens
  misc_feature: GZ8MTXP01BJ12T.39.29.C07.1.454.CMB.2.raw
  modified_base (245)..(245): a, c, t, g, unknown or other
  modified_base (260)..(260): a, c, t, g, unknown or other
  modified_base (328)..(328): a, c, t, g, unknown or other
  modified_base (392)..(392): a, c, t, g, unknown or other
  modified_base (598)..(598): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccaccatacaactgacaacgtccagccactagttgtttanacacgtaccctaaanaataacaactacttaacttggatcagacaagtaaattcggccagccctacgaagcactctatttccgnggcactccgtaccggggattcccgggggtacctgaccgtcttacgaggtggacaggtccgggtntggggactaggtaaccttcgacttccgtacacctatcacgcacgtaccctccgaggctacgaagattcggtacggtacttaaggtttacttaacgtggtactaagacgtagtaagttatttacgatttcggttcggtaggttccggttaacgggccgaaaacgggtaccgaaagggttacgaacttacgaaaaccgttagtaaggngtaacctagaccttactaagttcttaacg

SEQ ID NO: 434340 - DNA, 695 bp, Homo sapiens
  misc_feature: GZ8MTXP01ESXWP.39.29.C07.1.454.CMB.2.raw
  modified_base (256)..(256): a, c, t, g, unknown or other
  modified_base (689)..(689): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatcgacccagtcctccagactccctggctgtgtctcgtgggcgaggacggccaccatcaactgacaagtccagccatagttgtttacacacgaccctaaanaataacaacttacttaactgatcgagacaagtaaatcggccagccctaccaagccgtaactctactttccgcggactacgttcccgtaacccgggtacgttccccgggggtccctacggaccgtacttccgaaggttcggcgacggggtccgggttacgtcgggggtaactaacggttactttccgaaccttcctactaaacccattaccgacgacgtaacggcccccgttaaccgaaacggtccgtaagggtaaacgtgttacgggtaggttactttaacggttttaactttacgtagttaccgacgagtaaggtattaacgttaggtacttacggttccggtcgggttaacgttcgggaaaccggaacggggtaaccgttaagggttaccgaaacgttacgaaaacgttcgtgtacgctcgacttaccgtnttcgtg

SEQ ID NO: 434341 - DNA, 594 bp, Homo sapiens
  misc_feature: GZ8MTXP01DVV8Y.39.29.C07.1.454.CMB.2.raw
  modified_base (240)..(240): a, c, t, g, unknown or other
  modified_base (253)..(253): a, c, t, g, unknown or other
  modified_base (275)..(275): a, c, t, g, unknown or other
  modified_base (443)..(443): a, c, t, g, unknown or other
  modified_base (451)..(451): a, c, t, g, unknown or other
  modified_base (466)..(466): a, c, t, g, unknown or other
  modified_base (495)..(495): a, c, t, g, unknown or other
  modified_base (573)..(573): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctcagactccctggctgtgtctcgtgggcgaggagggccacatcaactgacaagtccagccactagttgttttanacagaccctaaanaataacaactacttaactgatnagacaagaaattggaccagccctactaagccgactctaactttccagggctaacgttccgtaaccccggggaagttccccgggggtaccctaggaaccgtaactttccgaagttgggaccagggtccgggttctgggggaactaggtactttcaacgtctacacctancacgcacncctcaggctagaagntgtgactagtttatacgtgtcagcaagtnttattgattcgttcgtgggtacgttaacgggacgaaacgggaaccgttaaggtacgaacttacgaaacgacgtgacgntcgcacctaagttcgttaacg

SEQ ID NO: 434342 - DNA, 534 bp, Homo sapiens
  misc_feature: GZ8MTXP02JFFEE.39.29.C07.1.454.CMB.2.raw
  modified_base (246)..(246): a, c, t, g, unknown or other
  modified_base (308)..(308): a, c, t, g, unknown or other
  modified_base (453)..(453): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttatacagccctaanaataacaactactaactggtatcagcagaaattaggccagcctacctaagcactcatttccnggcatccgtaccggatcccggggtcctgaccgactcagtcgcaggcggtctggggacaggtatttcactctcacatcagcagcctaccagtaccagaaagatgtgactagttttactactgtcagcaggatatgattagttccgnggtacgttcggacgtaaaggaccgtaaagggtcgaaactacaaacggtaacgtggtacggacgtcgacaacctagtcttcg

SEQ ID NO: 434343 - DNA, 544 bp, Homo sapiens
  misc_feature: GZ8MTXP02G7Z3F.39.29.C07.1.454.CMB.2.raw
  modified_base (237)..(237): a, c, t, g, unknown or other
  modified_base (249)..(249): a, c, t, g, unknown or other
  modified_base (305)..(305): a, c, t, g, unknown or other
  modified_base (329)..(329): a, c, t, g, unknown or other
  modified_base (334)..(334): a, c, t, g, unknown or other
  modified_base (348)..(348): a, c, t, g, unknown or other
  modified_base (367)..(367): a, c, t, g, unknown or other
  modified_base (398)..(398): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagttgtttanacagaccctaanaataacaactactaactgtatcagcagaaatggccagcctactaagcactcattcnggcatctaccgggatccgggtccngaccntcagtgcagcggtntgggacagtacttcactcncaccatcagcagccctccgaggctagaaagntcgtaggacttagtttaatcgtgtacagtcaggtattagtgaattgttaccgtggtacgttcggacgaaacgggtaacctaagggtacggaaacctacgaaaaccgtaacgtggtacggtactacggacaaccgtacgttacgtcg

SEQ ID NO: 434344 - DNA, 519 bp, Homo sapiens
  misc_feature: GZ8MTXP02FUTME.39.29.C07.1.454.CMB.2.raw
  modified_base (236)..(236): a, c, t, g, unknown or other
  modified_base (247)..(247): a, c, t, g, unknown or other
  modified_base (417)..(417): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacagccctaanaataacaactacttaacttgtatcagcaagaaataggccagcctactaagcgactcatttccgtggcatccgtacccgggaactcccggggtcctgaccgattcagtggcaggcgggtctggggacaggtatttccactctcaccatcagcagccctcgaggctagaagngtagtgactagtttatactgtcagcagatattgatagtcgtagcgttcgacaagggtaccaaggtacgaactacaaacgtaatgtgctacgcacactctacg

SEQ ID NO: 434345 - DNA, 685 bp, Homo sapiens
  misc_feature: GZ8MTXP02JUWQA.39.29.C07.1.454.CMB.2.raw
  modified_base (236)..(236): a, c, t, g, unknown or other
  modified_base (247)..(247): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttaanacagacctaanaataacaactacttaactgtatcagacaagtaaatacggccagcctacctaaagcgactctactttccgtgggactactccgtaacccgggaacgttccccggggtaccctaggtaaccgtacgttcggggtcggacgacggtccggggttcgtaggggactaacgtacttttccaccttccgtaccaaacctaactacaacgacgacgaccctacccgacggacgtacgaaagtaagtaggtacggtacgttaagtttaatttaacgttacgttacgtacgacgaaggtaagttaagttagtaagttaacgttaccgttacgggtacggttaccggtaccggtaaacgggaaaccggaaacgggtaacggtaaacgtaaaccgtaaaacgtaaaacgtaacgtaacggtacgtacgtacgaccgactactacgttcg

SEQ ID NO: 434346 - DNA, 499 bp, Homo sapiens
  misc_feature: GZ8MTXP02IZR0L.39.29.C07.1.454.CMB.2.raw
  modified_base (236)..(236): a, c, t, g, unknown or other
  modified_base (441)..(441): a, c, t, g, unknown or other
  modified_base (484)..(484): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacagccctaacaataacaactacttaactgtatcagcagaaataggccagcctctaagcgactcatttcctgggcatctacccgggaatccggggtccctgaccgattcagtggcagcgggtctggggacaggatttcactctcaccatcagcagcctcaggctgaagatgtgcagtttatactgtcagcagatatgatattcgngacgttcggcaagggaccaaaggtcgaactacaaacgaactgnggctgcaccatctcg

SEQ ID NO: 434347 - DNA, 554 bp, Homo sapiens
  misc_feature: GZ8MTXP02J2XFT.39.29.C07.1.454.CMB.2.raw
  modified_base (233)..(233): a, c, t, g, unknown or other
  modified_base (308)..(308): a, c, t, g, unknown or other
  modified_base (370)..(370): a, c, t, g, unknown or other
  modified_base (446)..(446): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcagaggccaccatcaactgcaagtccagccacagtgtttanacagccctaaacaataacaactacttaactgtatcagcagaaattaggccagcctctaaagcgactcatttccgngggcatccgtaacccgggaatcccggggtccctgaccgattccgagtggcaggccggggttntggggacagtactttcactctcaccatccagcagccctccaggctagaaagtatgtggctagtttactatgtcagnaggattattgattacgttccgtaggaccgtttcgggaccaaaggggacccaaagggtacgaacctacgaaaaccgaacgtgtacggctacgaccacccaattccttcg

SEQ ID NO: 434348 - DNA, 529 bp, Homo sapiens
  misc_feature: GZ8MTXP02INF72.39.29.C07.1.454.CMB.2.raw
  modified_base (237)..(237): a, c, t, g, unknown or other
  modified_base (315)..(315): a, c, t, g, unknown or other
  modified_base (367)..(367): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacagccctaacaataacaacttaacttaacttggtatcagcaagaaattaggccagcctcctaagcgactcatttccnggcatcctacccgggaatccggggtccctgaccgattcagtggcagcgggtntggggacagatttcactctcaccatcagcacgccctccgaggcctagaagatgtggactagttttattactgtcagcaggatattgatattccgtgtacgttcggacgaagggaccaaggtacggaactacgaaacgacgtgcggactgacacgtactctcg

SEQ ID NO: 434349 - DNA, 511 bp, Homo sapiens
  misc_feature: GZ8MTXP02J2Z31.39.29.C07.1.454.CMB.2.raw
  modified_base (235)..(235): a, c, t, g, unknown or other
  modified_base (246)..(246): a, c, t, g, unknown or other
  modified_base (306)..(306): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactacttaactgtatcagcagaattaggccagcctctaagcgactcatttccnggcatctacccggaatccggggtcctgaccgatcagtgcagcgggtctggggacagtattcactctacaccatcagcagccctcaggctagaagatgtggctagtttatactgtcagcagatatgattatccgtgacgttcggacgaaaggaccgaaaggtcggaactacgaaaacgaacgtgtacggcacggaccaccatctcg

SEQ ID NO: 434350 - DNA, 546 bp, Homo sapiens
  misc_feature: GZ8MTXP02G60S5.39.29.C07.1.454.CMB.2.raw
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttatacagccctaacaataacaactacttaacttggtatcagcagaaattaggccagcctcctaagcgactcatttcctggcatctacccgggaatcccggggtccctgaccgattccagtggcaggcggtctggggacagatttcactctcaccatcagcagcctccagctgaagatgtgctagtttattactgtcagcgagatattagattattccgtgacgtttcggaccgtaaaggggacccaaagggtacgtaaacgtacgaaaacgaacgttaagtcgggacctaggaccaaccgtacgtacttaccg

SEQ ID NO: 434351 - DNA, 603 bp, Homo sapiens
  misc_feature: GZ8MTXP02FPN1D.39.29.C07.1.454.CMB.2.raw
  modified_base (234)..(234): a, c, t, g, unknown or other
  modified_base (245)..(245): a, c, t, g, unknown or other
  modified_base (310)..(310): a, c, t, g, unknown or other
  modified_base (444)..(444): a, c, t, g, unknown or other
  modified_base (450)..(450): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccacagtgtttanacagccctaanaataacaactacttaacttgtatcagcaagaaattagccagcctactaagcgactctatttccgngggctagtccgtaacccggggaactccccggggtcctacggaccgtacttcagtcggcaggcgggttctggggactaggtactttaccacttctaccacctaatcaacgcacgcctacccgaggcctagaaagnttaggngtacgttagtttacttacgtgtacaggactaggattagtagtattacgttccggtggtaccggttacggaccggaaagggtacccgaaagggtacggaaactaaccgaaacggtactaacgggtcgaccgttacgaccaccgtagtcgtttcg

SEQ ID NO: 434352 - DNA, 516 bp, Homo sapiens
  misc_feature: GZ8MTXP02F306V.39.29.C07.1.454.CMB.2.raw
  modified_base (236)..(236): a, c, t, g, unknown or other
  modified_base (247)..(247): a, c, t, g, unknown or other
  modified_base (301)..(301): a, c, t, g, unknown or other
  modified_base (397)..(397): a, c, t, g, unknown or other
  modified_base (400)..(400): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactacttaactgatcagcagaaatggccagcctcaagcactcattcnggcatcgtaccgggaatccgggtcctgaccgatcagtgcagcggtctggggacagtattcactctacacatcagcagccctacaggctagaaagtntgngtactagtttatacgtgtcagacagtatatgatagttccgtaggtacgttcggaccaaagggaccaaagggtacgaacgtacgaaacgaacgtgtacggctacggcacactctacg

SEQ ID NO: 434353 - DNA, 520 bp, Homo sapiens
  misc_feature: GZ8MTXP02J2F9D.39.29.C07.1.454.CMB.2.raw
  modified_base (231)..(231): a, c, t, g, unknown or other
  modified_base (237)..(237): a, c, t, g, unknown or other
  modified_base (248)..(248): a, c, t, g, unknown or other
  modified_base (309)..(309): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtnttttanacagccctaanaataacaactacttaactgtatcagcagaattaggccagcctcctaagcgactcatttccnggcatctaccggatccggggtcctgaccgattcagtggcagcggtctggggacagatttcactctcaccatcagcacgccctccgaggctagaagatgtgactagtttatactgtacagcgagattatgattagttccgtggacgttcggaccgaaagggacctaaggtacggaactacgaaaacgacgtgtacggctcgacaccagtctg

SEQ ID NO: 434354 - DNA, 553 bp, Homo sapiens
  misc_feature: GZ8MTXP02HTJIY.39.29.C07.1.454.CMB.2.raw
  modified_base (240)..(240): a, c, t, g, unknown or other
  modified_base (322)..(322): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgacaagtccagccacagttgttttanacagaccctaaacaataacaactacttaacttggtatcagacaagaaattacggccagcctacctaagcgactcatttccgngggcatccgtaaccgggaactccggggtccctgaccgtattcgagtggcaggccgggtgtggggacaggtactttccacttctaccaccatcaagcacgccctccgaggctaggaagtatgtggactagtttattactgtacagcaggtatattgattacgttccgtggtacgttcggacgaaagggacaaggtacgaacacgaaacgactgtaggctcgacaccatctcg

SEQ ID NO: 434355 - DNA, 539 bp, Homo sapiens
  misc_feature: GZ8MTXP02IIX0I.39.29.C07.1.454.CMB.2.raw
  modified_base (226)..(226): a, c, t, g, unknown or other
  modified_base (236)..(236): a, c, t, g, unknown or other
  modified_base (248)..(248): a, c, t, g, unknown or other
  modified_base (307)..(307): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagctccctggctgtgtctctgggcgagagggccaccatcaactgcaagtccagccanagttgtttanacagccctaaanaataacaactactaactgtatcagcagaattagccagcctcctaagcgactcatttccnggcatcgtaccggatccgggtcctgaccgatcagtgcaggcggtctgggacagtatttcactctacacatcagcacgcctcgagctagaagatgtgactagtttattacgtgtacagcaggattagttgattagttccgtaggtaccgttcggaccgtaaagggacctaaagggttacggaaacctacgaaaacgacgtaaggtacggacgtacggacacccagttcgtacg

SEQ ID NO: 434356 - DNA, 579 bp, Homo sapiens
  misc_feature: GZ8MTXP02IXULY.39.29.C07.1.454.CMB.2.raw
  modified_base (246)..(246): a, c, t, g, unknown or other
  modified_base (310)..(310): a, c, t, g, unknown or other
  modified_base (373)..(373): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccacagtgtttatacagccctaanaataacaactacttaactgtatcagcaagaaattaggccagcctacctaagcgactcatttccngggcatcctacccgggaactccggggtccctgaccgattccagtgcaggcgggtctggggacnggtatttccactctcacatcagcagccctcaggctagaacgatcgtggtactagtttaacttaccgtgtaccgtagactaaggtattagttgaattacgttccgtagggtaccggtttaccggaccgtaaaggggacccaaagggttacgggaaacctaccgaaaacggaactggtacggactcggaccaaccgtagttaccttcg

SEQ ID NO: 434357 - DNA, 699 bp, Homo sapiens
  misc_feature: GZ8MTXP02IS858.39.29.C07.1.454.CMB.2.raw
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttatacagaccctaacaataacaactacttaacttggtatcagcaagaaattaggccagcctacctaagccgactctatttccgtgggctactccgtaacccggggaacttcccgggggtcccctggacccgtactttccgaaggttcggaccaggtcccggggttctcgggggaacctagggtacttttaccaccgttctaccaaccctaatccaacggccaacggcccctacccgacgggtccttaggaaacgtagtcgggtacgggtacttaacggtttttacttaaccgtgttaccgaaggtccgaaggggtattaagtttaggtaaacgtttacgtttaccgggtcgggtaacccggtttacggacccggtaaacggggtacccgaaaaggggtcgaaaaccgttacgaaaacggtaaccgtggtacgggtacttacggacctaacccgtagtttaccgttcg

SEQ ID NO: 434358 - DNA, 528 bp, Homo sapiens
  misc_feature: GZ8MTXP02F7ZAR.39.29.C07.1.454.CMB.2.raw
  modified_base (235)..(235): a, c, t, g, unknown or other
  modified_base (246)..(246): a, c, t, g, unknown or other
  modified_base (405)..(405): a, c, t, g, unknown or other
  modified_base (418)..(418): a, c, t, g, unknown or other
  modified_base (427)..(427): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactacttaacttggtatcagcagaaattaggcagcctcctaagcgactcattcctggcatcaccgggaatccggggtcctgaccgattcagtggcagcgggtctggggacagtattcactctcaccatcagcacgcctcaggctgaagatgnggcagttattacngtcagcagntatgatatcgtgacgttcggacctaaagggacctaaaggtacgggaactacgaaaaccggtaaactcggttaggcgtacggactaacccattcgtttaacg

SEQ ID NO: 434359 - DNA, 526 bp, Homo sapiens
  misc_feature: GZ8MTXP02JOE69.39.29.C07.1.454.CMB.2.raw
  modified_base (236)..(236): a, c, t, g, unknown or other
  modified_base (247)..(247): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactacttaacttgtatcagcagaaattagccagcctacctaagcgactcatttcctgggcatcctacccgggaatccggggtccctgaccgattcagtgcagcgggtctggggcaggtatttcactctcaccatcagcagcctcagctagaagatgtgctagtttatactgtacagtcaggatatgattagttccgtgacgttcggaccgtaaagggaccgaaaggtacgaaacgtacgaaacgtaacgtgtcggactcgacaccatcctcg

SEQ ID NO: 434360 - DNA, 591 bp, Homo sapiens
  misc_feature: GZ8MTXP02G3C3F.39.29.C07.1.454.CMB.2.raw
  modified_base (313)..(313): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttatacagccctaacaataacaactacttaactggtatcagcaagaaattaggccagcctacctaagcgactcattccgnggcactctaccggatccggggtcctgacgattcagtcgcaggcggtctggggacaggtactttcactctacaccatcagcacgcctcgaggcctagaagatcgtgactgtttactacgtgtacaggtacaaggtattaagttgaacttacgttccggtaggtaccggtttacggaccggtaaacggggtaacccgtaaaggggtacgaaaccgttaccgaaaaccggtaacgttggtacgggtccttacggtaccaaacccggttacgttacgttacg

SEQ ID NO: 434361 - DNA, 621 bp, Homo sapiens
  misc_feature: GZ8MTXP02GS60C.39.29.C07.1.454.CMB.2.raw
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggacgggccaccatcaactgcaagtccagccactagttgttttatacacgaccctaaacaataacaactacttaactgtatcagacaagaaattaggccagccctacctaaagcgactctactttccgtgggcacgtccgtaacccggggaactcccggggtccctggaccgtacttcgagtcggcgaggtccgggtcgtcggggacagtactttccactctacaccatcagcacgccctccgaggctagaagacgtgtggtacttagttttaattacgttgtcagacgagtattagttagtacttacgttcggtaggtaccggttaccggaccgtaaacggggaaccgtaaagggtacggtaaaccgttaacgaaaacgtacgtaagggttacggacgttacgaccaccgtacgttacgtttcg

SEQ ID NO: 434362 - DNA, 542 bp, Homo sapiens
  misc_feature: GZ8MTXP02GZRB3.39.29.C07.1.454.CMB.2.raw
  modified_base (312)..(312): a, c, t, g, unknown or other
  modified_base (377)..(377): a, c, t, g, unknown or other
  modified_base (392)..(392): a, c, t, g, unknown or other
  modified_base (406)..(406): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacagggacatcgtgatgacccagtctccagactccctggctgtgtctctgggcgagaggccaccatcaactgcaagtccagccacagtgttttatacagccctaaacaataacaactacttaacttggtatcagacagaaattaggccagcctcctaagcgactcatttccnggcatctacccgggaatccggggtccctgaccccgtattcaggtggcaggcgggtcgtgggaacngatttccactctacncatcagcagcctcnggctgaagatgaggctagtttattactgtcagctaggattagttgattagttccgtggtacgttcggaccgaaacgggaccgaagggtacggaacctacgaaaacgtcgtagtacgggcttacggcaaccctatcg

SEQ ID NO: 434363 - DNA, 585 bp, Homo sapiens
  misc_feature: GZ8MTXP02H6H2P.39.29.C07.1.454.CMB.2.raw
  modified_base (228)..(228): a, c, t, g, unknown or other
  modified_base (238)..(238): a, c, t, g, unknown or other
  modified_base (251)..(251): a, c, t, g, unknown or other
  modified_base (316)..(316): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctctggggcaggaggccaccatcaactgcaagtccagccanagttgtttanacagaccctaaanaataacaactacttaactggtatcagcaagaaatgcacgcctacctaagcgactactatttccgnggacagtccgtaccgggaatcccggggtccctgaccgtatcgagtggcaggcggtctgggacagtactttccacgttcacacactcagcacgcctccgagctgaaagagtgtagcttagtttatacgttgtacagacgaagtaatagttagaatttacgttcggtacggtaccggtttcggaaaccgtaaacgggaacccgtaaagggtacggtaaactacgtaaaacgaacgttaacggtacggacttacgactacctaagttctacg

SEQ ID NO: 434364 - DNA, 544 bp, Homo sapiens
  misc_feature: GZ8MTXP02HJ2O6.39.29.C07.1.454.CMB.2.raw
  modified_base (237)..(237): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacagccctaacaataacaactacttaactggtatcagcagaaattaggccagcctctaagcgactcattcctggcatcctaccgggatccggggtcctgaccgacttcagtggcagcgtgtcgtgggacagtattcactctacacatcagcacgccctcgagctagaagatgtggctagtttattacgtgtcagcaggtatagttgattagttcgtcggtaacgttcggaccgtaaacgggaaccgaagggtacggtaaacctacgtaaaacgaacgtggtacggactcggacctacctaagttccg

SEQ ID NO: 434365 - DNA, 606 bp, Homo sapiens
  misc_feature: GZ8MTXP02GD1L0.39.29.C07.1.454.CMB.2.raw
  modified_base (238)..(238): a, c, t, g, unknown or other
  modified_base (252)..(252): a, c, t, g, unknown or other
  modified_base (435)..(435): a, c, t, g, unknown or other
  modified_base (465)..(465): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccacagttgttttanacacgaccctaaanaaataaacaactaacttaacttggtatcagacaagtaaattacggaccagccctacaaagccgtaactctactttccgtgggccacgtcccgtaacccggggtaactccccggggtccctaggacccgtattccgaggtcggactaaggccgggtctcgggggactaaggtatttccacttcncacatcagcagccctccgaggctagaagtntggtgactagttattacgtgactagcagtattagttgaattcgtaccggtaggtaccgttcggacgaaagggtacctaaagggtacgtaaccgtaacgaaacgtaacgtggtacggactacgactacctattaccgtttag

SEQ ID NO: 434366 - DNA, 590 bp, Homo sapiens
  misc_feature: GZ8MTXP02ICXLH.39.29.C07.1.454.CMB.2.raw
  modified_base (239)..(239): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccacagttgtttanacagaccctaaacaataacaactacttaactggtatcagcaagaataggccagcctacctaagcgactctatttcctgggcatccgtacccgggaatccccggggtccctcggaccgtacttacgaggtggaccgaggccggggttcgtgggggacctaggtactttcaacctctacacccactcagcacgccctcccgaggctagaagagtgtggacttaagttttatacgttgtacagtcgaaggtattattgtattagttccgtgggtaacgtttcggaccgtaaggggacctaagggtacggtaactacgaaaacgacgtggtacgcgtaggacctacctatcgtcg

SEQ ID NO: 434367 - DNA, 608 bp, Homo sapiens
  misc_feature: GZ8MTXP02IXJNI.39.29.C07.1.454.CMB.2.raw
  modified_base (322)..(322): a, c, t, g, unknown or other
  modified_base (450)..(450): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagttgttttatacagccctaaacaataacaacttacttaacttggtatcagcaagaaattaggaccagcctacctaagccgactctaactttccngggcactccgtaaccccggggaaactcccggggtcccctggaccgtattcgagtggctaggccgggttctggggactagtactttccactctacacccatcaagcacgccctccgaggcctagaaagntggtgaccttaagttttactacgttgtacaggcgtaaggtattagttggtaaatttacgttccggtgggtaaccggttcggaccgtaaagggaccgtaaagggttacggaaactaccgaaaacgtaacgtggtacggactacgacacctattcttacg

SEQ ID NO: 434368 - DNA, 716 bp, Homo sapiens
  misc_feature: GZ8MTXP02HP6RD.39.29.C07.1.454.CMB.2.raw
  modified_base (330)..(330): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagactcccgtggctgtgtctcgtgggcgaggacggccacatcaactgacaagtccagccatagttgtttacacacgaccctaaacaataaccaacttacttaacttggtatcagacaagaattacggccagcctacctaaagccgtaactctatttccgngggactacgttacccgtaacccggggtaagtccccggggtccctaggtacccgtcttaccgaggttcggaccggtagggtccggggttcgtacgggggacctaaggttactttacccaacttcccgtaccaaccctaattccgaaacgtccgaaccgtcccgttaccgaacgggtaccttaaggaaacggttagttcgggtacgggtacctttaaggtttttaacttaacgttcgtacgaacggtacgtaaaggtatttagttagtaagtttaccggttaccgggtaggttaccggttccggaaccgggaaagggtacccgtaaagggtacggtaaactacgaaaccgtaaggtgtacggcttacgacctaccgtattcgtttacg

SEQ ID NO: 434369 - DNA, 507 bp, Homo sapiens
  misc_feature: GZ8MTXP02FSTMK.39.29.C07.1.454.CMB.2.raw
  modified_base (439)..(439): a, c, t, g, unknown or other
  modified_base (444)..(444): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttatacagccctaacaataacaactactaacttgtatcagcagaaataggccagcctcctaagcgactcatttcctgggcatcctacccgggaatcccggggtcctgaccgattcagtggcagcgggtctgggacagatttcactctcaccatcagcagcctccaggctagaagatgtgctagtttatactgtcagcagatatgatnttcgngacgtcgaccaagggtaccaaaggtcggaaactacgaaacgaactgtagctcgacaccatctg

SEQ ID NO: 434370 - DNA, 549 bp, Homo sapiens
  misc_feature: GZ8MTXP02GD4UJ.39.29.C07.1.454.CMB.2.raw
  modified_base (236)..(236): a, c, t, g, unknown or other
  modified_base (247)..(247): a, c, t, g, unknown or other
  modified_base (409)..(409): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacagccctaanaataacaactactaacttggtatcagcagaaattaggccagcctcctaagcgactcatttcctgggcatctacccgggaatccggggtccctgaccgattcagtggcagcgggtctgggacagatttcactctcacatcagcagcctcaggctgaacgatgngcagtttattactgtcagcaggatattgattacgttccgtaggtaccgttcggtaccgaaagggaacccgtaaaggtacggaacgttaacgaaaaccgtaactaaggtacggactacggacctaacctacgtactttccg

SEQ ID NO: 434371 - DNA, 510 bp, Homo sapiens
  misc_feature: GZ8MTXP02JTJC3.39.29.C07.1.454.CMB.2.raw
  modified_base (236)..(236): a, c, t, g, unknown or other
  modified_base (247)..(247): a, c, t, g, unknown or other
  modified_base (310)..(310): a, c, t, g, unknown or other
  modified_base (411)..(411): a, c, t, g, unknown or other
  modified_base (426)..(426): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactacttaacttggtatcagcagaaattaggccagcctctaagcgactcatttccnggcatcctacccgggaatccggggtccctgaccgattcagtggcagcgggtctgggacagatttcactctcaccatcagcacgcccccagctgaacgatgngctagtttacttacngtcagcagatattgatattccgtgacgttcggaccaagggaccaaggtggaactacgaaacgactgtggctcgcacatctgttc

SEQ ID NO: 434372 - DNA, 533 bp, Homo sapiens
  misc_feature: GZ8MTXP02HDRUZ.39.29.C07.1.454.CMB.2.raw
  modified_base (236)..(236): a, c, t, g, unknown or other
  modified_base (247)..(247): a, c, t, g, unknown or other
  modified_base (432)..(432): a, c, t, g, unknown or other
  modified_base (467)..(467): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccacagtgtttaanacagccctaanaataacaactactaactgtatcagcaagaaattaggccagcctacctaaagcgactctatttcctgggactatccgtaacccgggaaatcccggggtccctaggaccgattcgagtggcaggcggttctggggacaggtactttcacttctacacccatcagcacgcctccgagctagaagatgnggactagtttatactgtcagcagatatgatatcgngtacgttcgcgtaaggacctaaggtacggaactacgaaacgaagtgtggctacgactaccatcgtc

SEQ ID NO: 434373 - DNA, 513 bp, Homo sapiens
  misc_feature: GZ8MTXP02F7ZNF.39.29.C07.1.454.CMB.2.raw
  modified_base (237)..(237): a, c, t, g, unknown or other
  modified_base (249)..(249): a, c, t, g, unknown or other
  modified_base (386)..(386): a, c, t, g, unknown or other
  modified_base (390)..(390): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacagaccctaanaataacaactactaacttgtatcagcagaaataggccagcctctagcgactcatttcctggcatctacccgggaatccggggtcctgaccgattcagtgcagcgggtctggggacagactttcactctcaccatcancacncctcagctagaagatgtgctagtttatactgtcagcagtatattgatatcgtgacgttcggacgaagggacgaaggtacggaactacgaaacgtacgtggtcgacgtacgacacactcgtacg

SEQ ID NO: 434374 - DNA, 541 bp, Homo sapiens
  misc_feature: GZ8MTXP02GK3I3.39.29.C07.1.454.CMB.2.raw
  modified_base (236)..(236): a, c, t, g, unknown or other
  modified_base (247)..(247): a, c, t, g, unknown or other
  modified_base (273)..(273): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactacttaactggtatcancagaaattaggccagcctcctaagcactcattcctggcatctacccgggaatccggggtccctgaccgattcagtggcagcgggtctggggacaggtattcactctcaccatcagcagccctcacggctacgaagactgtggactagtttattactgtcagcagtatattgattacttcgtaggtacgttcggaccgaagggtaaccctaagggtacggaaccgtacgaaaacgtaacgtaaggtcggactacggacaccacttctcg

SEQ ID NO: 434375 - DNA, 540 bp, Homo sapiens
  misc_feature: GZ8MTXP02G6TZY.39.29.C07.1.454.CMB.2.raw
  modified_base (236)..(236): a, c, t, g, unknown or other
  modified_base (248)..(248): a, c, t, g, unknown or other
  modified_base (455)..(455): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtatctgggcgagagggccaccatcaactgcaagtccagccacagttgtttanacagccctaaanaataacaactacttaactgtatcagcagaaatagccagcctacctaagcgactcatttcctggcatccgtacccgggaatccggggtcctgaccgattcgagtgacagcgggtctggggaccagtactttcactctacaccatccaagcacgccctaccgaggtcctagaaacgtatagtggtactagttttaatactgtcagcagntatgatagtcgtgacgttcgacgaagggacaaggtacgaactaacgaaaccgtagtcgtacgacgtacgaccaacctatacgtcg

SEQ ID NO: 434376 - DNA, 541 bp, Homo sapiens
  misc_feature: GZ8MTXP02JJRT8.39.29.C07.1.454.CMB.2.raw
  modified_base (236)..(236): a, c, t, g, unknown or other
  modified_base (248)..(248): a, c, t, g, unknown or other
  modified_base (305)..(305): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagaccctaanaataacaactacttaactgtatcagcagaattaggcagcctctaagcactcattccnggcatcgtaccggatccggggtcctgaccattcagtgcaggcggtctggggacagtacttcactctcacatcagcacgccctcgagctagaacgatggtggactaggtttattacgtgtacaggacaggtatagttgattagttccgtggtaccgttcgggaccgtaaagggaccgtaaagggtacggaaactacgaaaacgtacgtggtacggctacggacaccgtatcgttacg

SEQ ID NO: 434377 - DNA, 638 bp, Homo sapiens
  misc_feature: GZ8MTXP02JJJVG.39.29.C07.1.454.CMB.2.raw
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagttgttttatacacgaccctaacaaataacaactacttaacttggtatcagacaagaaattaggccaagcctacctaaagcgactcaatttccgtggctatccgtacccgggaacgtcccggggtccctacgaccgtacttcagtgcgaggcgggtctggggacaggtactttcgactctcaccatcagccacgccctacccgaggcctagaaacgtagtggtcgtacgttagttttaacttacgtagttccaaggtctaaagggtattaaagttgaattaccgttccggtagggtacccgttcgggaaccgtaaacggggaacccgtaagggtacggtaaacctaacggaaaaccggtacgtaacggtacggtacccgtacgtaccgtaacctacggttcctttaccgg

SEQ ID NO: 434378 - DNA, 662 bp, Homo sapiens
  misc_feature: GZ8MTXP02JXTAS.39.29.C07.1.454.CMB.2.raw
  modified_base (241)..(241): a, c, t, g, unknown or other
  modified_base (256)..(256): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggacgggccaccatcaactgcaagtccagccactagttgttttanacacgtaccctaaanaataacaacttacttaacttggtatcagacaagaaattacggccagcctaccgtaaagccgactctatttccgtgggacctagtccgtaacccggggaagtccccggggtccctaggaccgtattccgaggtcggaccgtagggccgggttacgtggggaactaggtacttttccaacgttcctaccaaccctatcccgaagccgacgcccgtaccgacggtaccgtaggaaaagtgtggttacggtacgttaaagttttaacttacgtacgtacgaggacgtaaggtattaaggttactagttaccgtttcgggtaggtaccggttaccgggaaccgaaaggggacccgtaaaggtacgaaacgtaccgaaacgtacgtgtacggctcgaccacgtacgttctcg

SEQ ID NO: 434379 - DNA, 509 bp, Homo sapiens
  misc_feature: GZ8MTXP02JHBVX.39.29.C07.1.454.CMB.2.raw
  modified_base (236)..(236): a, c, t, g, unknown or other
  modified_base (247)..(247): a, c, t, g, unknown or other
  modified_base (300)..(300): a, c, t, g, unknown or other
  modified_base (325)..(325): a, c, t, g, unknown or other
  modified_base (392)..(392): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactacttaactgtatcagcagaatgcagcctcagcgactcattccnggcatcgtaccggatccggggtccngaccgattcagtgcaggcggtctgggacagatttcactctcaccatcagcacgcctcgagctagaangtgtggctagtttatactgtacagcagattatgattagttcgtaggacgttacggacgaagggaccaaggtacggaactacgaaacgtacgtgtacggactcgccactacgtctacg

SEQ ID NO: 434380 - DNA, 641 bp, Homo sapiens
  misc_feature: GZ8MTXP02JGDFB.39.29.C07.1.454.CMB.2.raw
  modified_base (316)..(316): a, c, t, g, unknown or other
  modified_base (414)..(414): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccactagtgttttatacacgaccctaaacaataaacaactacttaacttggtatcagcaagaaatggcagcctactaagcgactcatttccngggctactccgtaacccgggaactcccggggtccctggaccgtacttcgaggtcggaccaggccggggttctgggggaccaggttactttccacttcnccaaccagtcacgcacgccctacccgaaggtcctaaggaaagtgtggtcgggacttaggttttaacttacgtgtacccgtaggataagggtaatttagttaggtaattaacgtttccgggtacgggtaccggtttaccgggaaccggtaaacggggaaccgaaagggttacggaaacttaacgaaaaccggtagtaaggtcgtacgtcaccaaccttacgtacgtcg

SEQ ID NO: 434381 - DNA, 571 bp, Homo sapiens
  misc_feature: GZ8MTXP02HZBS2.39.29.C07.1.454.CMB.2.raw
  modified_base (239)..(239): a, c, t, g, unknown or other
  modified_base (253)..(253): a, c, t, g, unknown or other
  modified_base (391)..(391): a, c, t, g, unknown or other
  modified_base (566)..(566): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggaggccaccatcaactgcaagtccagccacagttgttttanacacgaccctaaanaataacaacttacttaactggtatcagacaagtaaattacggaccagccctacctaagccgactctatttcctgggcatccgtaacccgggaagtcccggggtcccctgaccgattcgagtcggcgaggccgggttcnggggacagtactttccgactctacaccatcacgcacgcctccgagctagagagtgagacttagtttattacgtagtcgagacgagtatagttgattacgtcgtacgtacggttccggacgtaaacgggacctaagggtacgaactacgaaacgtagtggtcgactacgcaacctntctcg

SEQ ID NO: 434382 - DNA, 603 bp, Homo sapiens
  misc_feature: GZ8MTXP02JGSK8.39.29.C07.1.454.CMB.2.raw
  modified_base (236)..(236): a, c, t, g, unknown or other
  modified_base (313)..(313): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccacagtgttttanacagaccctaacaataaaccaactacttaactgtatcagcaagaaattaggccagcctacaagcgactcatttccgnggcatccgtaacccgggaatcccggggtccctgaccgtattcgagtggcaggcgggtctggggacagtatttccactctccaccatcacgcacgccctccgaggcctagaacgtagtgtggtcttaagttttattacgttgtacagacgaggtattagttagtattacgttccggtagggtaccggttacggacccggtaaaggggtacccgtaaagggttacggaaaaccttaaccgaaaacggtaaaccgtggtacggaccgtacgacctaccgtacttaccgtttcg

SEQ ID NO: 434383 - DNA, 594 bp, Homo sapiens
  misc_feature: GZ8MTXP02GGO76.39.29.C07.1.454.CMB.2.raw
  modified_base (249)..(249): a, c, t, g, unknown or other
  modified_base (307)..(307): a, c, t, g, unknown or other
  modified_base (336)..(336): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttatacagaccctaanaataacaactacttaactgtatcagcaagaaataggccagcctctaagcactcattcnggcatacgtacccgggaatccggggtccngaccgattcagtgcaggcggtctggggacaggtactttcgacctctaccacatcagcagcctccgagctagaagatgtggactagtttatacgtgtcagtacgaaggtattagttagaattcgttaccggttagggtaccggtttacggacccggtaaaagggggtaacccgtaaaagggggtacggtaaaaccgttaaaccggaaaaacggtaaccgtgggttaacggccgtaggtaccaaccgtactcgtttaacg

SEQ ID NO: 434384 - DNA, 573 bp, Homo sapiens
  misc_feature: GZ8MTXP02I3YX2.39.29.C07.1.454.CMB.2.raw
  modified_base (311)..(311): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagttgtttatacagccctaacaataacaactacttaacttgtatcagcaagaattaggccagcctcctaagcgactcatttccnggcatccgtaacccgggatcccggggtccctggaccgtattccagtcgcgagccgggtctggggacaggtatttccgactctaccacctatcagcacgccctccgagcctagaagatcgtgactagtttacttacttagtccagtcaaggtatattgaattagttccggtaggtacgtttacggaccgtaaagggaccgtaaaggtcggtaaacctacgaaaaccgtacgtggtacggtctacggactacccgtatctttcg

SEQ ID NO: 434385 - DNA, 533 bp, Homo sapiens
  misc_feature: GZ8MTXP02GW2JV.39.29.C07.1.454.CMB.2.raw
  modified_base (236)..(236): a, c, t, g, unknown or other
  modified_base (247)..(247): a, c, t, g, unknown or other
  modified_base (335)..(335): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactactaactgtatcagcagaatagccagcctctaagcgactcatttccgtggcatccgtacccgggaatcccggggtccngaccgattcgagtggcaggcggtctggggacagtactttcactctcaccatcagcacgccctcgaggctagaagatgtgactagtttatactgtacagcaggtatatgtattacgttccgtaggtacgttcggacgtaaagggaccgaaagggtcggaaactacgaaacgtactgtcggactacgacacctagtctcg

SEQ ID NO: 434386 - DNA, 743 bp, Homo sapiens
  misc_feature: GZ8MTXP02IY7MD.39.29.C07.1.454.CMB.2.raw
  modified_base (239)..(239): a, c, t, g, unknown or other
  modified_base (322)..(322): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccacagttgtttanacagaccctaacaataacaacttacttaacttggtatcagcaagaaattaggccagcctacctaagccgactctactttccgngggactactccgtaaccccggggaacgtccccgggggtcccctaggaaccgtatttccgaggttcgggcacgggtccggggttctgggggacctaggtactttcccgaaccttcctaccaaccctaagtccaacgacccgtacgccccttacccgaaggggtccttaagggaaaacggtaagttcgggtacggggtacctttaaagggttttttaaccttaaccgtttgttaccgaacggtaccgtaaagggtaatttaagttaggtaactttacgtttacccgggtaggggttaacccgtttaccggggaaccgtaaaacgggggtaaacccgtaaaagggggttaccggtaaaaccgtaaccggaaaacgtaacgtaacggttcgggaacttcggacctaaccgtactttacgtttacg

SEQ ID NO: 434387 - DNA, 570 bp, Homo sapiens
  misc_feature: GZ8MTXP02GLYHZ.39.29.C07.1.454.CMB.2.raw
  modified_base (238)..(238): a, c, t, g, unknown or other
  modified_base (314)..(314): a, c, t, g, unknown or other
  modified_base (376)..(376): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagttgttttanacacgaccctaaacaataaacaactactaacttgtatcagcaagaaatagccagcctctaagcgactctatttccngggcactaccgtacccggggaatccggggtaccctggaccgacttcgagtggcaggcggtcnggggacagtactttcactctaccacatcaacgcacgcctccaggcctagaaacgagtagtggactaggttttaatacgtgtcagcaaggtatagttgaattacgttcgtacggtacggttacggaccggaaggtaaccgaaggtacggtaaacctacgaaaacgtagtggtcgacgtcgaccactactcttacg

SEQ ID NO: 434388 - DNA, 518 bp, Homo sapiens
  misc_feature: GZ8MTXP02I8POJ.39.29.C07.1.454.CMB.2.raw
  modified_base (231)..(231): a, c, t, g, unknown or other
  modified_base (236)..(236): a, c, t, g, unknown or other
  modified_base (247)..(247): a, c, t, g, unknown or other
  modified_base (411)..(411): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtntttanacagccctaanaataacaactacttaactgtatcagcaagaattaggccagcctcctaagcgactcatttcctgggcatcgtaccgggaatccggggtccctgaccgattccgagtggcagcgggtctggggacaggtatttccactctacacatcagcagcctcaggctgaacntgtgctagtttatactgtcagcaggatactgattatccgtgtacgttcgacgaggtaccaggttacgaactacgaacgaacgtgtcggactacgctaccagtccttg

SEQ ID NO: 434389 - DNA, 660 bp, Homo sapiens
  misc_feature: GZ8MTXP02HJJUG.39.29.C07.1.454.CMB.2.raw
  modified_base (238)..(238): a, c, t, g, unknown or other
  modified_base (308)..(308): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgacaagtccagccacagttgttttanacagccctaacaataacaactacttaacttggtatcagcaagaatagccagcctcaagcgactcattcgnggcacgtccgtaaccgggatcccggggtcctgaccgtattcgagtgcacggtcgggtctggggacctaggtactttccgaccttctaccacctaatcgaacggcaacggccctaccgaacggcctaagaaacgtagttaggtacgggtaccttaaggttttaattaacccgtggttaccaacggtacgtaaggtaactttaagttaggtaaacgtttcgtttacccgggttaagggtacccggttttacgggaacccggttaaaaggggtaacccgtaaaaggggtacccggtaaaacgttaccgaaaaccggtaacgtggttaacgcgttacgaccaccgtatcgtttacg

SEQ ID NO: 434390 - DNA, 669 bp, Homo sapiens
  misc_feature: GZ8MTXP02JJA3I.39.29.C07.1.454.CMB.2.raw
  modified_base (186)..(186): a, c, t, g, unknown or other
  modified_base (244)..(244): a, c, t, g, unknown or other
  modified_base (324)..(324): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtntctcgtgggcgaggacgggccaccatcaactgacaacgtccagccactagttgtttanacacgaccctaacaataacaacttacttaacttgtatcagacaagtaaatacggccacgcctacaagcactctattccgnggcatccgtacccgggactcccggggtcctgacctactcgagtcgcgacggcggggtctggggacagtacgtttccacgttctaccacactacgacgccacgtccctacgacggaccgttaaggaaacgtagtcgggttcgtaacgttagttttaacttaaccgttgtaccgtaggaccgtaaaggtatttagttacgtaacgttacggtttacccggtaggttaacccggtttacggaacccggaaacgggggtaaacccgtaaaggggtaacggtaaaccgtaaaccgtaaaaccggtaacggtcggtacggtacgtacgacctaaaccgtcgttacgtttcg

SEQ ID NO: 434391 - DNA, 703 bp, Homo sapiens
  misc_feature: GZ8MTXP02JMG3L.39.29.C07.1.454.CMB.2.raw
  modified_base (240)..(240): a, c, t, g, unknown or other
  modified_base (341)..(341): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggacgggccaccatcaactgacaagtccagccacagttgtttanacacgaccctaaacaataacaactaacttaacttggtactcagacaagtaaattacggccaacgtccctaccgtaaagccgtaacctctaacttttcccgnggggacctaactacccgtaaccccggggtaaacgtccccgggggtccctaggacccgtacttcgaaggtcggacacgggtccgggttccgtgggggaacctaggttactttccgaaccttcctacaaccctatcgaacgccaacgcccttacccgaggacctaaggaaacgtgtcggtacggtacgtaagtttttaactaccgttgtaccgtagaccgtaagggtacttaagtttagaagtttaaccgttccggtacggtaccggttacccgggacgtaaacggggaacccgtaaagggttacggaaaccgttaacgaaaacggtaccgtggacggtactacggacctaacgtctacgttcg

SEQ ID NO: 434392 - DNA, 616 bp, Homo sapiens
  misc_feature: GZ8MTXP02ILOY5.39.29.C07.1.454.CMB.2.raw
  modified_base (239)..(239): a, c, t, g, unknown or other
  modified_base (251)..(251): a, c, t, g, unknown or other
  modified_base (316)..(316): a, c, t, g, unknown or other
  modified_base (488)..(488): a, c, t, g, unknown or other
  modified_base (536)..(536): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacggccaccatcaactgacaagtccagccacagttgtttanacagaccctaanaataacaacttacttaactgtatcagcaagtaaatgaccagcctacctaagcactctatttccgnggctacgtccgtaaccccgggaacttccccggggtccctaggtacccgtacgtttaccgaacgggttcggaccgtaagggtcccggggttctacgggggtacctaaggtactttaccgacttccgtacctacccatcacgcacgtcctaccgagacctagaacgtagttcgnggtacttagtttatacgttgtacagacagtattagtatatacgttcgnggtacgttacgacgtaaggacgtaaggtacgaactacgtaaacgtaacgtcggtacgtactcgactacgtaagtcttacg

SEQ ID NO: 434393 - DNA, 782 bp, Homo sapiens
  misc_feature: GZ8MTXP02HBRVK.39.29.C07.1.454.CMB.2.raw
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggccaccatcaactgacaagtccagccacgagttgttttacacacgtaccctaaacaataaacaacttaacttaactggtatcagacaagtaaattacggaccacgacctaccgtaaagccgtactactaacgtttccgtacggggcctaacgttcccggtaacccggggtaaacgttccccgggggttacccctagggtaaccccggtaacctttccgaacgggttcgggaccgtacggggtcccggggttacgttacggggggaacctaagggttaaccgtttttcccaaccgttcccgttaccaaaccctacttaccgaaacggccaaccggtaccctacccgacgggtccttacggaaaagtacgtggtacggtaccgttaaggttttaacttacgttacgttacgtagaccgtaggtattaagttagtaatttaccggttacggtacggggttaaccgtttaccggggaaccgtaaacgggggtaacccgtaaaggggtaaccggaaaccgtaaaccgaaaaccggtacggtaaggtacgtaacgtacggacctaacctacggttactttccg

SEQ ID NO: 434394 - DNA, 786 bp, Homo sapiens
  misc_feature: GZ8MTXP02G1D9J.39.29.C07.1.454.CMB.2.raw
  modified_base (239)..(239): a, c, t, g, unknown or other
  modified_base (330)..(330): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgacaagtccagccacagttgtttanacacgaccctaaacaataacaactacttaacttggtatcagacaagaaattacggccacgccctacctaaagccgtaactctactttccgngggacacgttaccgtaacccgggtaacgtccccggggttccctacggtacccgtacgtttccgaaggttcggaccgtacgggtccggggttacgtcgggggaacctaaggttacttttccaaccgttcctaccaaccctaatccgaacggccaacggtcccttacccggaacgggtcctaacggaaaacggtagttacgggtacggttaaccgttaaaggtttttaacttaaccggttagttaccgaacgtaccgtaaaggttaactttagttagtaaactttcggtttacccggggtacggggtaacccggtttacccgggaaaccggtaaaacgggggtaaaccctaaaagggggttaaccgggtaaaacccgttaaaccggtaaaaaccggtaacggttaacgggtaccggtaccgttacggaaacccgtaacctaacgttcccggtttaccg

SEQ ID NO: 434395 - DNA, 589 bp, Homo sapiens
  misc_feature: GZ8MTXP02H4M0K.39.29.C07.1.454.CMB.2.raw
  modified_base (239)..(239): a, c, t, g, unknown or other
  modified_base (276)..(276): a, c, t, g, unknown or other
  modified_base (322)..(322): a, c, t, g, unknown or other
  modified_base (364)..(364): a, c, t, g, unknown or other
  modified_base (430)..(430): a, c, t, g, unknown or other
  modified_base (441)..(441): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcaggacggccaccatcaactgcaagtccagccacagttgtttanacagaccctaaacaataacaacttacttaactggtancagcaagaaattacggccacgcctacctaagctactctatttccgnggctagtccgtaacccggggatccccggggtccctgaccgtntcgagtcgcgtaggcgggttctggggactagtactttccgactctacaccatcagcctagaccccncgagctagagngtgtagtacttagtttactacgtgacgagtagtaagtattagttgtacttacggttcgtgggtaccgtacggaaccggtaacggacgtaacgggtacgaaacgtacgaaacgtagtcggtacgacgtacgacctaccgtacttcgtcg

SEQ ID NO: 434396 - DNA, 738 bp, Homo sapiens
  misc_feature: GZ8MTXP02GE9U6.39.29.C07.1.454.CMB.2.raw
  modified_base (243)..(243): a, c, t, g, unknown or other
  modified_base (256)..(256): a, c, t, g, unknown or other
  modified_base (333)..(333): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgacaagtccagccactagttgtttanacacgaccctaanaactaacaactacttaacttgtatcagacaagtaaattcggaccagccctacctaaagccgtaactctactttccgngggcctaagtcccgtaaccccggggtaacgtccccggggtccctacggacccgtactttccgaggtcggacgacgggtcccggggttacgtgggggaacctaacggtacttttcccgacctaccttaccgaaccctaatccgaaacggtccctaaccggtcccccttacccggaaacggtcccgttaaggaaacgtagttgggtacggtacctttaaaggttttacttaccgttggtaccgaggtacgtaaggtattagttagtaacgttacggtttccgggtagggtacccggttaccggaaacccggtaaagggggtaacccgtaaaggggttaccgaaaaccgttaaccgaaaacggtaaccgtggtacgtaccgtacgacccgtacctagtttccgttacg

SEQ ID NO: 434397 - DNA, 528 bp, Homo sapiens
  misc_feature: GZ8MTXP02IHB25.39.29.C07.1.454.CMB.2.raw
  modified_base (238)..(238): a, c, t, g, unknown or other
  modified_base (416)..(416): a, c, t, g, unknown or other
  modified_base (428)..(428): a, c, t, g, unknown or other
  modified_base (508)..(508): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttaanacagacccctaacaaataacaactacttaaacttggtatcagcaagaaattaggccagcctcctaaagccgactcatttcctgggctatccgtacccgggaatcccggggtccctgaccgacttcagtggcagcgggtctggggcagtacttcactctcacatcagcacgcctaccgngctagaagatgngactagtttatactgtacagtcagatagttgacttatccgtggtacgttcgacagggacaaggacgaacacaaaggtacngtcgactcgacaccatctcg

SEQ ID NO: 434398 - DNA, 592 bp, Homo sapiens
  misc_feature: GZ8MTXP02I84PS.39.29.C07.1.454.CMB.2.raw
  modified_base (236)..(236): a, c, t, g, unknown or other
  modified_base (241)..(241): a, c, t, g, unknown or other
  modified_base (253)..(253): a, c, t, g, unknown or other
  modified_base (275)..(275): a, c, t, g, unknown or other
  modified_base (314)..(314): a, c, t, g, unknown or other
  modified_base (442)..(442): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccatagttntttanacagaccctaanaataacaactactaactgtatnagcagaataggccagcctcctaaagcgactctattccgngggcacgtccgtacccgggaactcccggggtccctaggacccgtattcgagtcggacgaggtcgggtctggggacaggttactttccacttcctacacctatcagcacgccctaccgaagctagaagntaggtcgactagtttattacgtgtacagacgagtattagttagtattagttacggtacggtaccgttacggaccgtaaagggacccgtaaaggtacggaaactaaacgaaaccgtaagtggtacggactacggacctactacttacttcg

SEQ ID NO: 434399 - DNA, 738 bp, Homo sapiens
  misc_feature: GZ8MTXP02F6RE8.39.29.C07.1.454.CMB.2.raw
  modified_base (241)..(241): a, c, t, g, unknown or other
  modified_base (255)..(255): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccacagttgttttanacacgaccctaaanaataaacaacttacttaacttggtaatcagacaagtaaaattacggccagtccctacctaaagccgtactctaacgtttccgtagggacctacttcccggtaaaccccggggtaaacgttccccgggggtcccctaggaaccccgtagtttcccgaaggtcgggaccgtacgggtccggggttcgttacgggggaacctaagggttaacctttttccccgaaccgttcctacctaaaccctaatacccgtaacgacccgaacggtcccccttacccggaaacggtcccgttaaggaaaacggtattaggggtacgtaaccgtttaaaggtttttaactttaacgttcgttccgaaaggtacgtaagggtaatttagttacgtaaattacgttcggtacggtaccgttacgggaccgaaagggtaccgaaaggtcggaaactacgaaaccgtagtaaggtcggactcgacgaactactcgtacg

SEQ ID NO: 434400 - DNA, 592 bp, Homo sapiens
  misc_feature: GZ8MTXP02HIOHG.39.29.C07.1.454.CMB.2.raw
  modified_base (241)..(241): a, c, t, g, unknown or other
  modified_base (254)..(254): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatcgacccagtctccagacctcctggctgtgtctcgtgggcgaggacggccacatcaactgacaagtccagccatagttgtttanacacgacctaaanaataacaactactaacttagtatcagacagaatagcagcctacaagacgactactacttcgtggcactccgtaccggacgtcccgggtcctcgaccgactacgagtcggcgaaaacggtcggacgtggacgagtacttcactcactaccgactcacgcacgccctccgacgcgtagaagagtgtggacgtagtttattacttgtacagtagaaggtatatagtattacgttacgtagggtacgttcggacgtaacgggaaccgtaaacgggtacgtaaacgtaacgaaaccgtaacggtaacggtacggtacgttacggacgacctacgtacgttccg

SEQ ID NO: 434401 - DNA, 598 bp, Homo sapiens
  misc_feature: GZ8MTXP02GB3SU.39.29.C07.1.454.CMB.2.raw
  modified_base (238)..(238): a, c, t, g, unknown or other
  modified_base (249)..(249): a, c, t, g, unknown or other
  modified_base (273)..(273): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccacagtgttttanacagccctaanaataacaactactaactgtatcancagaaattgccagcctactaagcgactctatttcctgggactactcctaacccggggtaactcccggggtccctgaccgtattcagtcgctaggccggttctgggggacaggtatttaccaccttctccaaccatcagcacgccctccgaggcctagaagtatgtgtactaagttttactacgttgtccaaggcaagggtattagttagtattacgttccggtagggtaccggtttaccggaccggaaacggggtacctaaagggtacggtaaactaacgaaaacgtaccgtaaggtacggctacggaccaacctatacccgttg

SEQ ID NO: 434402 - DNA, 714 bp, Homo sapiens
  misc_feature: GZ8MTXP02FRB07.39.29.C07.1.454.CMB.2.raw
  modified_base (242)..(242): a, c, t, g, unknown or other
  modified_base (256)..(256): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggagggccaccatcaactgacaagtccagccactagttgtttanacacgaccctaaanaataaacaacttaacttaacttggtatcagacaagtaaattacggaccagtcctacctaagccgtactctactttccgtgggacctacgtaccgtaaccccggggtaacgttccccggggtaccctacggaccgtacgttccgaggtcggacgagggtccggggttcgtcgggggaactacggttaactttccgaaccttcctaccaaccctactacgaacgaccgaacggtcccttaccggacggtcctaaggaaacgtagtggtacggtacttaagtttacttacgtgtacgtaggaccgtaaggtaattagttacgtaaacgttcggttaccggggtacgggtaaccgggttaccgggaccgggaaaacgggtaaccggtaaaggggttacgaaaaccgtaccgtaaaaccggtacgtggtacggacgttacgaccgtaactacgtcgtttaccg

SEQ ID NO: 434403 - DNA, 554 bp, Homo sapiens
  misc_feature: GZ8MTXP02HEUNS.39.29.C07.1.454.CMB.2.raw
  modified_base (237)..(237): a, c, t, g, unknown or other
  modified_base (313)..(313): a, c, t, g, unknown or other
  modified_base (395)..(395): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagttgtttanacagccctaacaataacaactacttaactgtatcagcaagaaattaggccagccctacctaagcgactcatttccngggcatccgtacccgggaatcccggggtccctggaccgattcgagtcggcaggccgggtctggggacagtactttccactcncacccatccagcacgccctcgagctagaagatgtggactagtttatacgtgtcagcgagtattatgtatagttcggtgtacgttcggacgaagggacctaagggtacgaacgtacgaaaacgtaacgtggtacggctacggaccaccgtacgttactcg

SEQ ID NO: 434404 - DNA, 517 bp, Homo sapiens
  misc_feature: GZ8MTXP02J0WPI.39.29.C07.1.454.CMB.2.raw
  modified_base (237)..(237): a, c, t, g, unknown or other
  modified_base (248)..(248): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgttttanacagccctaanaataacaactacttaactggtatcagcagaaattaggccagcctctaagcgactcatttcctgggcatctacccgggaatccggggtcctgaccgatcagtgcagcgggtctggggacagtatttcactctcaccatcagcagccctcaggctgaagatgtgctagtttatacgtgtcagcaggattatgatagttccgtggtacgttcggacgagggaccaaggtcgaactacgaaaacgaactgtacgcgtacgacactactctacg

SEQ ID NO: 434405 - DNA, 542 bp, Homo sapiens
  misc_feature: GZ8MTXP02F43IY.39.29.C07.1.454.CMB.2.raw
  modified_base (236)..(236): a, c, t, g, unknown or other
  modified_base (247)..(247): a, c, t, g, unknown or other
  modified_base (307)..(307): a, c, t, g, unknown or other
  modified_base (395)..(395): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactactaacttggtatcagcagaaattaggccagcctctaagcgactcattcnggcatcaccgggaatccggggtcctgaccattcagtgcagcggtctggggacagatttcactctcacatcagcagcctcagctagaantgtgctagtttatactgtcagcagatatgatacgttcgtggacgttcggacgtaaagggacccgaaaggttacggaaacgttaaccgaaaacgtaaacgtaacggttacgggaacttacggaccaaacccggtactacgtttaacgg

SEQ ID NO: 434406 - DNA, 611 bp, Homo sapiens
  misc_feature: GZ8MTXP02I9NX1.39.29.C07.1.454.CMB.2.raw
  modified_base (235)..(235): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccacatcaactgcaagtccagccacagttgtttanacagtaccctaaacaataacaactacttaactggtatcagcaagaaattacggccagcctacctaagcgactctactttccgtagggcagtcccgtaaccccggggtaacgtccccggggtcccctaggaacccgtacttaccgaggtcggacgacggtccggggttcgtgggggacctaggtactttccacttctaccacctatcacgcacgccctacgaggctagaacgtagtgtgactagtttatacttgtacagacagtattagttagattacgttcggtacggtacgttaccggaccgtaaagggaccgtaaagggtacgaaacgtaaccgaaacgtaacgtggtacgacgtacgtaccacgtactcgtcg

SEQ ID NO: 434407 - DNA, 523 bp, Homo sapiens
  misc_feature: GZ8MTXP02HT561.39.29.C07.1.454.CMB.2.raw
  modified_base (235)..(235): a, c, t, g, unknown or other
  modified_base (307)..(307): a, c, t, g, unknown or other
  modified_base (403)..(403): a, c, t, g, unknown or other
  modified_base (419)..(419): a, c, t, g, unknown or other
tcagtcgcactagtcacgaccggtgctcgatttagagtgctacgaagggaaaggggagctacaacaggcaggcaggggcagcaagatggtgttgcagacccaggtcttcattctctgttgctctggatctctggtgcctacggggacatcgtgatgacccagtctccagactccctggctgtgtctctgggcgagagggccaccatcaactgcaagtccagccacagtgttttanacagccctaaacaataacaaactactaacttggatcagcagaaattaggcagcctctaaagcactcattccnggcatctaccgggaatccggggtccctgaccgatcagtgcagcggtctgggacagactttcactcacacccatcagcagcctcaggctgaagatgngatagtttatactgtnagcagatattgattacgtcgtaggtacgtcggaccgtaaagggaactaaggtacggaaactacgaaaacgacgtaacggtgacgtacgacctacctagtactcg

SEQ ID NO: 434408 - DNA, 753 bp, Homo sapiens
  misc_feature: GZ8MTXP02FXLB2.39.29.C07.1.454.CMB.2.raw
  modified_base (239)..(239): a, c, t, g, unknown or other
  modified_base (250)..(250): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccacagttgttttanacagccctaanaataacaactacttaacttgtatcagcagaaattaggccagcctacctaagcgactctatttccgtgggcacgtccgtaccccggggtaaacttccccggggtccctacggtacccgtactttccgaaggttcggaccgtagggtccggggttcgttcgggggaacctaagggttaactttttacccgaaccgttccgttacccaaaccctaattaccaacggccctaaaccggccccttacccgaacggggacccttaaggaaaacggtaacgttagggttcgggtacctttaaaggtttttaactttaaccgttggttacccgaaagggaccgtaaaggtaatttaaagtttcggttaaatttaacgtttcccggtacggggttaaccggtttacccgggaaccggaaaacggggtaacccgtaaaaggggttacggaaaaccttaaccgaaaacgtaaccgttgggttaacggcttacggaccaaccgtacgtctttacg

SEQ ID NO: 434409 - DNA, 636 bp, Homo sapiens
  misc_feature: GZ8MTXP02HU2YT.39.29.C07.1.454.CMB.2.raw
  modified_base (241)..(241): a, c, t, g, unknown or other
  modified_base (254)..(254): a, c, t, g, unknown or other
  modified_base (458)..(458): a, c, t, g, unknown or other
  modified_base (461)..(461): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacggccaccatcaactgacaagtccagccacagttgttttanacacgaccctaanaataacaacttacttaacttgtatcagcaagaattacggccagcctacctaaagccgactctatttccgtggactataccgtacccgggtaacgtcccggggtcccctaggaccgtattccgagtcggactaggccgggttctcgggggacaggtactttccgaacctctaccaccatcacgcacgccctacgagtctagaagntgngctagttttatacgtgtacagtcgaggtattattgaagttacgttccgggtacgggtaccgttcgggaacccgtaaaggggtaaacccgaaaggggttacggtaaaccttaacggaaaacccgtagtaacgggttaggaccgtttacggacctacccggtaatttccgtttaacg

SEQ ID NO: 434410 - DNA, 887 bp, Homo sapiens
  misc_feature: GZ8MTXP02GJKYG.39.29.C07.1.454.CMB.2.raw
  modified_base (236)..(236): a, c, t, g, unknown or other
  modified_base (248)..(248): a, c, t, g, unknown or other
  modified_base (318)..(318): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagaccctaanaataacaactacttaacttggtatcagacaagaaattaggccagcctacctaaagcgactctatttccgngggcactccgtaaccccggggtaaacgtccccggggtaccctacggaccgtaactttccgaaggttcgggaccgtacgggtcccggggttacgtcggggggaaacctaaggggttaacgtttttacccgaaccgtttacccgttacccaaacccctaaacgttacccgaaaaccggtcccgaaaccggtcccccgttacccggaaaacggggtccccgttaaacgggaaaacggttagtttacggggttacgggtacccgtttaaaggtttttaaacgtttaaacccgttggttaacccgaaagggtacccgtaaaacggggttaaactttaaacgtttacggttaaaacgttttaccggtttacccccggggttagggggtaaaaccccggttttacccgggggaaaacccccggtaaaaaggggggtaacccccgtaaaagggggtttaaccgggaaaaacccgtttaaaacccggaaaaaaccgggttaaaaccggttcggggttaaccggggtaacctttaccgggaacccgtaaaaccccgtaagtttacccgttttaacccgg

SEQ ID NO: 434411 - DNA, 585 bp, Homo sapiens
  misc_feature: GZ8MTXP02IP8AE.39.29.C07.1.454.CMB.2.raw
  modified_base (230)..(230): a, c, t, g, unknown or other
  modified_base (240)..(240): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacggccaccatcaactgacaagtccagccanagttgtttanacacgaccctaacaataacaactactaactgtatcagacaagaaataggccagcctacctaagcgactcatttccgtggcatccgtaacccgggactcccggggtccctggaccgtattcgagtggcaggcgggtctgggacagtattccactctacacctatcagcacgcctaccgagctagaagagtgtgactagtttactacgtgtacaggacgagtattattagtattacgttccgtagggtacgttacgggaccgtaaaggggaacccgtaaaggggtacgaaacgtaaccgtaaaacgaaccgtgtacgggactacggactacccgtattaccgttacg

SEQ ID NO: 434412 - DNA, 554 bp, Homo sapiens
  misc_feature: GZ8MTXP02HHK5U.39.29.C07.1.454.CMB.2.raw
  modified_base (227)..(227): a, c, t, g, unknown or other
  modified_base (231)..(231): a, c, t, g, unknown or other
  modified_base (238)..(238): a, c, t, g, unknown or other
  modified_base (250)..(250): a, c, t, g, unknown or other
  modified_base (270)..(270): a, c, t, g, unknown or other
  modified_base (273)..(274): a, c, t, g, unknown or other
  modified_base (277)..(277): a, c, t, g, unknown or other
  modified_base (305)..(305): a, c, t, g, unknown or other
  modified_base (380)..(380): a, c, t, g, unknown or other
  modified_base (383)..(383): a, c, t, g, unknown or other
  modified_base (387)..(387): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccanagtnttttaanacacgacctaanaataacaactactaactgancannaanaatagcagcctacagcactctacttcgnggcactccgtaccggacgtccgggtcctgacgactcagtcgacagcggtcgtggactagtactcactctacacancancacncctacgagtacagaagtgtagtacgtattagtttatacgttgtagagacgaagtattattagtacttacgttcggtacggtacggtacggaacgaaacgggtacgaaacggtacgtaaactaacgaaacgtaacgtggtacgtacgtacgacacctaacgtacgtcg

SEQ ID NO: 434413 - DNA, 840 bp, Homo sapiens
  misc_feature: GZ8MTXP02GCGPW.39.29.C07.1.454.CMB.2.raw
  modified_base (241)..(241): a, c, t, g, unknown or other
  modified_base (254)..(254): a, c, t, g, unknown or other
  modified_base (331)..(331): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccactagttgtttanacagaccctaaanaataacaactacttaacttggtaatcagcaagtaaattacggaccagccctaccaaagccgacctctaactttccgnggggacctaacgttacccgtaaccccggggtaacttccccgggggtacccctaggtacccgtactttaccgaaggttcgggaccgtaggggtcccggggttactacggggggaaccctaaggggtttaactttttacccgaacccgtttccgtaaccctaaaccctaacttacccgaaaccggacccgtaacccggtaccccgttaccccggaaacggggtaccccgttaagggtaaaacggtagttacgggttacggtaacccgtttaaaggtttttaaacctttacgttacggtaccgtaagggaaccgtaaagggtatttaaggtttaagtaacgtttaacgtttcccggggttacggggtaacccggtttaccggggaaacccggtaaaacgggggtaaacccgtaaaacgggggttaaacggtaaaacccgttaaaccggaaaaaccggtaaaccggtgggttaccggtacgtacggaccctaacgttacgttcgtttaaccgg

SEQ ID NO: 434414 - DNA, 670 bp, Homo sapiens
  misc_feature: GZ8MTXP02HVMRB.39.29.C07.1.454.CMB.2.raw
  modified_base (244)..(244): a, c, t, g, unknown or other
  modified_base (259)..(259): a, c, t, g, unknown or other
  modified_base (338)..(338): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggacgggccaccatacaactgacaagtccagccactagttgttttaanacacgacccctaaanaaataaccaacttacttaactggtaactcagacaagtaaattacggaccagccctacctaagccgactctactttccgnggcctaagttccgtaacccggggtagtcccggggtacccctaggtacccgtattcgaggtcggacagggtccgggttgtggggactagtactttccgacctcctacaacctatacaacgcgaacgcccgtacccgaggtacctaggaaacgtacgttgtacggtacctttaaggttttaacttaccgttgtacgacggagaagtattagttagtacgtttacttcggtacggtaccggtttacggacggtaaacggggaccgtaaagggttacgaaacgtaaccaaaacggtacgtaacggttcgacgtacgacctacctactttacgtccg

SEQ ID NO: 434415 - DNA, 929 bp, Homo sapiens
  misc_feature: GZ8MTXP02GDXF1.39.29.C07.1.454.CMB.2.raw
  modified_base (231)..(231): a, c, t, g, unknown or other
  modified_base (241)..(241): a, c, t, g, unknown or other
  modified_base (255)..(255): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacggccaccatcaactgacaagtccagccanagttgtttanacacgaccctaaanaaataacaactaacttaacttggtaatcagacaagaaacttcggccagccctacctaagccgtactctactttccgtgggcagttacccggtaacccggggtaacgttccccggggtaccctggtaacccgtacgtttaccgagggttcggaccgaacggggtcccggggtttcgtacggggggaacctaacggttaaacgtttttcccaaacccgtttccgttaccccgaaacccgtaaactttcccgaaaccggtaccccgtaaaccggcccccgtttaacccgaaaccgggggttacccttaaagggggaaaaaccgttacgttacggggttaacgggttacccggtttttaaaagggtttttttactttaaaaccccggttgtttaacccgggaaacgggtttaacgtaaagggggtttaaactttaacggtttttaggtaaaaaaccgtttacccgggtttttacccggggttaaacgggggtttaaacccccggggtttaacccgggggaaaacccccgggtaaaaggggggttaaacccccgtaaaaagggggtttaaacccgtaaaacccggtttaaacccggaaaaaacccggttaaacccggtttgggggttaaacccgtacccgttaccggaaacccgttaccgtttacgtttaccgtttccg

SEQ ID NO: 434416 - DNA, 557 bp, Homo sapiens
  misc_feature: GZ8MTXP02GSK33.39.29.C07.1.454.CMB.2.raw
  modified_base (238)..(238): a, c, t, g, unknown or other
  modified_base (249)..(249): a, c, t, g, unknown or other
  modified_base (314)..(314): a, c, t, g, unknown or other
  modified_base (421)..(421): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtcctccagactccctggctgtgtctctgggcgagagggccaccatcaactgcaagtccagccacagttgtttanacagccctaanaataaacaactacttaactggtatcagcaagaaattaggccagcctacctaagcgactcattccnggcatcgtacccgggaatccggggtccctggaccgtattcagtggcaggcggtctggggacaggtatttcactctcacagtcaagcacgcctccagcctgaagatgngggtctagtttattactgtacagtacaaggattattagattagtccgtgggacgttcggaccgtaaaggaccaaaggggtcgaaaccgtacgaaaacgtaactaaggtcggtactacggacctaccattaccgtcg

SEQ ID NO: 434417 - DNA, 652 bp, Homo sapiens
  misc_feature: GZ8MTXP02I2JJC.39.29.C07.1.454.CMB.2.raw
  modified_base (251)..(251): a, c, t, g, unknown or other
  modified_base (267)..(267): a, c, t, g, unknown or other
  modified_base (342)..(342): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggcccaaccatcaactgacaacgtccacgaccacgtagttgttttanaccacgacccctaaanaataaacaacttacttaacgtgtatcagacaagtaaatacgccaacgccctacctaaagcgactctactttccgnggactacgtccgtaacccgggacgtcccgggtcctaggaccgtatcgaggtcgacgacggccggttcgaggggactagtacttccacctcgtacacctatcacgtccacggtcctaccgagtccgtaagaacgtagtggtacgtacgttaattttaacgtacgttgtaccgagtacgtaaggtattagttagtaactttaccggttacggttacggtaccggtttaccggaaacggtaacgggaaccggtaaagggaacgtaaccgtaacgaacgtaacgtggacgacgtacgaccacgtacttcgtacg

SEQ ID NO: 434418 - DNA, 727 bp, Homo sapiens
  misc_feature: GZ8MTXP02I0I4B.39.29.C07.1.454.CMB.2.raw
  modified_base (257)..(257): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccactagttgtttactacacgaccctaaanaataacaacttacttaacttggtatacagacaagtaaacttcggaccacgcctacctaagccgactactacgtttccgagggctactaccggtaaccgggacgttcccggggtcctaggacctacgttaccgaggtcgacgaggtccggggtctggggactagtactttccacgttcctaccgactactacacgaccgtaacgtccctacccgaggtaccgttaaggaacgttaagttcggtacggttaccgtttaaggtttttaaccttacgttacggttaccaagggtacgtaaggtaatttaacggttagttaaacgtttacgttaccgggtagggtttcccggtttaaccggggaaccggtaaacggggtaacccgtaaagggggttaacctaaaccggtaaccgtaaaacggtacggttaacggttacgacgttacgaccgttaaaccgtacgtttaccgttacg

SEQ ID NO: 434419 - DNA, 503 bp, Homo sapiens
  misc_feature: GZ8MTXP02FEW0Y.39.29.C07.1.454.CMB.2.raw
  modified_base (235)..(235): a, c, t, g, unknown or other
tcagtcgcactagtcacgaccggtgctcgatttagagtgctacgaagggaagggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccacagtgttttanacagccctaacaataacaactacttaacttggtatcagcagaaattaggccagcctcctaagcgactcatttcctgggcatctacccggggaatccggggtcctgaccgattcagtgcagcggtctgggacagatttcactctcaccatcagcagcctccaggctgaagatgtggctagtttattactgtcagcagatattgatattccgtgacgttcggccaagggaccaaggtcgaactcaaacgaactaagtgctgcaccatctg

SEQ ID NO: 434420 - DNA, 655 bp, Homo sapiens
  misc_feature: GZ8MTXP02HQR2P.39.29.C07.1.454.CMB.2.raw
  modified_base (231)..(231): a, c, t, g, unknown or other
  modified_base (241)..(241): a, c, t, g, unknown or other
  modified_base (255)..(255): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatcgacccagtcctccagactccctggctgtgtctcgtgggcgaggacggccaccatcaactgacacgtcagccanagttgtttanacacgaccctaaanaataaacaacttacttaactagtatacagacaagaatacgccagcccctacaagcctactctactttcgaggctacgtaccgtaacccggacgtcccggggtaccctaggaccgtagttaccgagtcggaccgtaggtccgggtggtaggggacctaggtactttcacctctacgaccatcgaacgctaccgcccgtaccgaggacctaagaacgtgtacggtagtactttacgtttataccgtggacctaggaacctagggtattaaagtgttaacgttaccgttacgggtacggtaccggttaccggaccggttaaaacgggaccgtaagggtaccgtaacgtaacgtaaaccggtagtaacgtcggtaactcggaacctaccgtagtttcttaaccg

SEQ ID NO: 434421 - DNA, 813 bp, Homo sapiens
  misc_feature: GZ8MTXP02GWGCK.39.29.C07.1.454.CMB.2.raw
  modified_base (238)..(238): a, c, t, g, unknown or other
  modified_base (244)..(244): a, c, t, g, unknown or other
  modified_base (258)..(258): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtatcgtgggcgaggacgggccaccatacaactgacaagtccagccaatagttntttaanacacgaccctaaanaaataaacaacttaacttaacttggtaatcagacaagaaattaggaccagaccctacctaaagcgtaactctaattttcccgtaggggaccacgttacccggtaacccccggggtaaacgttcccccggggggtacccctacggtaacccggtaacgtttacccgaaggttcggggacccgaggggtacccggggttccgtaggggggtaaaccaacgggttaactttttacccgaaaccttcccgtacctaaaccccctaattaccgaaacgaccgtaaccggcccccttaacccgaaaggggtacccgtaagggtaaaacggtaacgttcggggtagggtaacccttaaagggtttttaaacctttacgttagttacccgtaagaccgtaaagggtaacttaagtttacggtaaattacgtttccggggtacgggtaaccggttacgggaaaccggaaacggggtaaacccggtaaaagggttacgaaaccgttaaaccgaaaagtaaaccgtggttaccgtagtacggacctacccggtaagtctttaaccg

SEQ ID NO: 434422 - DNA, 515 bp, Homo sapiens
  misc_feature: GZ8MTXP02F58EP.39.29.C07.1.454.CMB.2.raw
  modified_base (235)..(235): a, c, t, g, unknown or other
  modified_base (246)..(246): a, c, t, g, unknown or other
  modified_base (405)..(405): a, c, t, g, unknown or other
tcagtcgcactagtcacgaccggtgctcgatttagagtgctacgaagggaaaggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccacagtgtttanacagccctaanaataacaactactaactggtatcagcagaaattaggcagcctcctaagcgactcatttcctgggcatctacccgggaatccggggtcctgaccgattcagtgcagcggtctggggacagatttccactctcaccatcagcagcctcagcctgaagatgnggacagtttatactgtcagcagatattgatatcgtgacgttcggacctaaagggaccaaaggtcggaaactacgaaacgtaaactggtaggctagacacaactcgttacg

SEQ ID NO: 434423 - DNA, 629 bp, Homo sapiens
  misc_feature: GZ8MTXP02G7VSE.39.29.C07.1.454.CMB.2.raw
  modified_base (262)..(262): a, c, t, g, unknown or other
  modified_base (470)..(470): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacggccaccatacaactgacaagtccagccacgtagttagtttacacacgtaccctaaanaaactaaacaacttacttaacgtgtactcagacaaagtaaagtacggaccaacgtccctactaagccgtactctacttccgtggactacgtaccggtaacccgggacgtccccggggtcctacggacctacgtcgagtcggacgaggtcggtcgtcggggactagtacttccactcacacatcacgcacgccctacgagctagaacgngtgtacgtacttagtttaatacgtagtacgagtagagtatagttagattacgtcggtacggtaccggttacggaaccggtaaagggaccgtaaagggtaacgtaacgtaaaccgaaaacgtacggtaaggtacggactacggacctacctagttcctcg

SEQ ID NO: 434424 - DNA, 569 bp, Homo sapiens
  misc_feature: GZ8MTXP02HAXSW.39.29.C07.1.454.CMB.2.raw
  modified_base (236)..(236): a, c, t, g, unknown or other
  modified_base (247)..(247): a, c, t, g, unknown or other
  modified_base (311)..(311): a, c, t, g, unknown or other
  modified_base (375)..(375): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaatgcaagtccagccacagttgtttanacagccctaanaataacaactacttaactgtatcagcaagaaatacgccagtcctcctaaagcgactcatttccngggacatccgtaaccgggaactcccggggtcctagaccgactttcgagtcggcaggtccgggtntggggactaggtactttcactctcaccatcagtcagcctccgagtcctagaacgtagtgtgtacttaggtttatacgttgtctaggacaggtattagttgaattacgttccgtaggtacgttacggacgaacgggtacctaaagggtacgaacgtacgaaacgtacgtaagtcggactgacaccgtatcttacg

SEQ ID NO: 434425 - DNA, 559 bp, Homo sapiens
  misc_feature: GZ8MTXP02HO61M.39.29.C07.1.454.CMB.2.raw
  modified_base (241)..(241): a, c, t, g, unknown or other
  modified_base (380)..(380): a, c, t, g, unknown or other
  modified_base (551)..(551): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacgggacatcgtgatgacccagtctccagactccctggctgtgtctcgtgggcgagacgggccaccatcaactgacaacgtccagccacagttgttttanacacgaccctaaacaataacaacttacttaactggtactcagacaagtaaatcggaccagcctacaagcgactctattccgtggctatccgtaccggactccggggtcctgaccgtctcgagtcgacgaggccggttgngggacagtacttcacttcacaccatcagcacgcctaccgagctagaagtgtgtacggattagtttacttacgttagactagagtagtattagtgtattacgtcgtaggacgttacggacgtaaaggaccgtaggtacgactaacgaaacgtgtaagcgacgtacgactacncttcgtac

SEQ ID NO: 434426 - DNA, 598 bp, Homo sapiens
  misc_feature: GZ8MTXP02FOUL2.39.29.C07.1.454.CMB.2.raw
  modified_base (238)..(238): a, c, t, g, unknown or other
  modified_base (251)..(251): a, c, t, g, unknown or other
  modified_base (322)..(322): a, c, t, g, unknown or other
  modified_base (410)..(410): a, c, t, g, unknown or other
  modified_base (425)..(425): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccactagtagtttanacagaccctaaanaaataaacaactacttaacttggatcagacaagaaattaggccagcctacctaagcgactctactttccgnggcatccgacccgggaatcccggggtcctagaccgtattccagtgacaggcgggtctggggacagtattcactctacacatcagcacnccctcagctagaagntgtggactagtttactacgtgtacaggacaaggtattagttagtactacgttacggtacgggtaccgttcgggaaccgaaacggggtaccgtaaaggggtacgaaaccgtaaaccgaaaacggtaaacgtcggtacggtacctacggacctaaaccgtacttcggtttaaccg

SEQ ID NO: 434427 - DNA, 608 bp, Homo sapiens
  misc_feature: GZ8MTXP02FYOV6.39.29.C07.1.454.CMB.2.raw
  modified_base (240)..(240): a, c, t, g, unknown or other
  modified_base (255)..(255): a, c, t, g, unknown or other
  modified_base (334)..(334): a, c, t, g, unknown or other
  modified_base (399)..(399): a, c, t, g, unknown or other
  modified_base (414)..(414): a, c, t, g, unknown or other
  modified_base (422)..(422): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagcccatagttgttttanacacgacccctaaanaaactaactaacttaacttaacgtgtacacgagacaagtaaacgtacgaccacgtcctacaacgcctactctacttcgnggactacgtaccgaccgggtacgtcccgggtacctacgaccgtctcgagtcgcgtcggcggtcgnggactagtacttacnctcacacnacacgcacgcctacgacgcgagaacgtagtggagttacgttagtttactacgtgtacgagacgtagtatacgttagtacgttacggttacggtacggtaccggtacggaacggaaacgggtacgaaacggtacgtaacctaacgaacgtacgtggacgtacgtacgacctacgtacgttacgttcg

SEQ ID NO: 434428 - DNA, 569 bp, Homo sapiens
  misc_feature: GZ8MTXP02JO1U4.39.29.C07.1.454.CMB.2.raw
  modified_base (239)..(239): a, c, t, g, unknown or other
  modified_base (249)..(249): a, c, t, g, unknown or other
  modified_base (374)..(374): a, c, t, g, unknown or other
  modified_base (403)..(403): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccgatcaactgcaagtccagccacagtgtttanacagcctaanaataacactacttaactgtatcagcagaaatggcagcctcaagcgatcattcgtggcatccgtaccgggatcccggggtcctaggacctattcagtgcaggcggtctggggacagtcttcattcncaccatcgagcacgcctcgaggctagaangtgtggactagttaatctgtcagacaggatagtttcgattacgttccgtagggtacgttacgggaccgtaacggggacccgtaaagggtacggtaaaccgtaacgaaaacccggtaagtaacggttcgggaaccttcggaaccgtaaccgtacgttctttaaccgg

SEQ ID NO: 434429 - DNA, 705 bp, Homo sapiens
  misc_feature: GZ8MTXP02FX4MI.39.29.C07.1.454.CMB.2.raw
  modified_base (243)..(243): a, c, t, g, unknown or other
  modified_base (257)..(257): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagacctccctggctgtgtctcgtggcgaggacgggccaccatcaactgacaagtccagccactagttagtttanacacgaccctaaanaataaacaacttaacttaactgtatcagacaagtaaattcggaccagccctactaagccgtactctacgtttccgagggactacgtcccgtaacccggggtacgtccccggggtaccctaggtacccgtagttccgaggtcggacgacggtccggggttgtcgggggactagttactttcccacttctaccaacctaagtccaacggccacgtccctccgaaggccttaaggaacgttagtacgggtacggtacttaacggttttacttaccgtgtaccgtagacggtaaggttatttaacgttgttaacgttacggttaccgtacggggtaccggttaccggaaacggaaacggggtaacccgtaaaggggttacggaaaaccgtaaaccgtaaacgtaaccggttgggaccgtacggtacctaccgtaccgtaacttccgttacgg

SEQ ID NO: 434430 - DNA, 665 bp, Homo sapiens
  misc_feature: GZ8MTXP02H28ZW.39.29.C07.1.454.CMB.2.raw
  modified_base (284)..(284): a, c, t, g, unknown or other
  modified_base (332)..(332): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatgacccagtctccagactcccgtggctgtgtctcgtgggcgaggacggccaccatacaactgacaagtccagccactagttgtttaacacacgtaccctaaacaataacaacttacttaactagtancagacaagaagttacggccacgcctactaagctactactactttccgnggctacgtccgtaaccgggtacgtcccggggtaccctacgacgtacttcgacgtcgacgaggtccgggtactggggaactagtactttcgaccttcgtaccaccgtactacacgtacacgccctacgaggacgtagaaacgtacgtgtacggtacttagtttacgtacgttgactagcgtaaggtattagttaagtaagtttacggttacggttacgggtacggttaccgggaaccggtaaacgggtaaaccgtaaaggggtaaccgtaaaccgtaaaccgtaaaacgtaccggttaaggtacgaccgttcggacctaaccgtacgttactcg

SEQ ID NO: 434431 - DNA, 687 bp, Homo sapiens
  misc_feature: GZ8MTXP02HHBTX.39.29.C07.1.454.CMB.2.raw
  modified_base (263)..(263): a, c, t, g, unknown or other
  modified_base (337)..(337): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgccgtacggggacatcgtgatcgacccagtcctccagacctcccgtggctgtgtatcgtgggacgaggacgggccaccatacaactgacaagtccagccactagttgtttacacacgaccctaaanaataactaacttacttaactgtatacagacaagtaatacggccacgtccctactaagccgtactctatttccgnggactacgtacccggtaaccgggtacgttcccggggtacctcggaacctagttaccgaggttcggacggtagggtccggggtacgcggggtaactaacggtactttccaccctcgtacaccctatacgacgcaccggtccctacgcgacgtaaggacgtagttcggtcgtacttagttttactacgttcgtacgaggtacgtaaggttattaggttagtacgttacggttaccggtacgggtacccgttacgggaacccggaacgggttaaaccggaacggttacggtaaaaccgtaaccgtaacggtaacggtcgtacggtacctcgaacctactaccgtttcttaccg

SEQ ID NO: 434432 - DNA, 800 bp, Homo sapiens
  misc_feature: GZ8MTXP02ILU46.39.29.C07.1.454.CMB.2.raw
  modified_base (261)..(261): a, c, t, g, unknown or other
  modified_base (350)..(350): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacgggacatcgtgatgacccagtctccagactccctggctgtcgtctcgtgggcgaggacgggccaaccatcaactgacaagtccagccactagttgttttaactacacgtaccctaaanaactaacaacttaacttaacttggtactcgagacaaagtaaacgttacggccaacgtccctaccgtaaagcgaaccttctagtttccgngggctaacttccggtaacccggggaaagttcccccggggtacctacggtaacccgtattttaccgaggttcggaccgtacgggtcccggggttacttaccgggggaaactaacggttacgtttttacccgaacccgtttccgaaccttaaacccgaattacgaaacggtcctaaacgtccccgttacccgagggtccttaaaggaaacgtacgtacggttacgggtaccttaaggttttacttacgtagtaaccgtagtacgtaaaggtcttaacgtttagtaacgttaacgtttacccgggtagggtaaccccggtttcgggaaaccccggtaaaagggggtaaaccctaaaagggggttaaccgtaaaacccgttaacgtaaaaccgggtacgttaacggtaaacggtccgttaaacggaccctaccggttaacgtaccgtttaaccg

SEQ ID NO: 434433 - DNA, 595 bp, Homo sapiens
  misc_feature: GZ8MTXP02FPQ3V.39.29.C07.1.454.CMB.2.raw
  modified_base (237)..(237): a, c, t, g, unknown or other
  modified_base (248)..(248): a, c, t, g, unknown or other
tcagtcgcactagtcacgaccggtgctcgatttagagtgctacgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccacagtgtttanacagccctaanaaataacaactacttaacttgtatcagacaagaaattcggaccagccctacctaaagccgtaactctatttccgtgggctactccgtacccggggaattccccggggtcctacggaccgtattccgaggtcggacacggcggggttacgtcgggggaactaggtaacgtttccacttctcgaaccctatcacgcacgccctcaggcctagaagagtgtgtacttagtttaattactgttacaggtacgaaggtattaagttgtaacttacgttcgtgggtaccgttcggaccgaagggtaaccgagggtacgactacgaaacgagtgtacgctacgcacctatcgtc

SEQ ID NO: 434434 - DNA, 608 bp, Homo sapiens
  misc_feature: GZ8MTXP02FUD6M.39.29.C07.1.454.CMB.2.raw
  modified_base (229)..(229): a, c, t, g, unknown or other
  modified_base (239)..(239): a, c, t, g, unknown or other
  modified_base (251)..(251): a, c, t, g, unknown or other
  modified_base (312)..(312): a, c, t, g, unknown or other
tcagtcgcactagtcacgaccggtgctcgatttagagtgctacgaagggaaagggggagctacaacaggcaggcaggggcagcaaggatggtgttgcagacccaggtcttcatttctctgttgctctggatctctggtgcctacggggacatcgtgatgacccagtctccagtactccctggctgtgtctctgggcgagagggccaccatcaactgcaagtccagccanagtgttttanacagaccctaanaataacaactacttaacttgatcagcaagaaataggccagcctactaagcactcatttccnggcactcgtacccggggaactccggggtcccagtaccgattccgagtcggacgaggtcgggtcgtcggggacacggtaatttcaacctttcaccaccctatccgaagccaacgccctacgacggtcctagaaagtctgtcggattacgtttatacgtgtacgagtacaaggtattacgttgtaacttacgttccggtaggtacgttacgggaccgtaaacggggaccaagggttacggaaacttacgaaaacgtaacgtggtcgtacccgttaggaccctaacgtctccgtttacg

SEQ ID NO: 434435 - DNA, 637 bp, Homo sapiens
  misc_feature: GZ8MTXP02HFHY5.39.29.C07.1.454.CMB.2.raw
  modified_base (238)..(238): a, c, t, g, unknown or other
  modified_base (244)..(244): a, c, t, g, unknown or other
  modified_base (280)..(280): a, c, t, g, unknown or other
  modified_base (317)..(317): a, c, t, g, unknown or other
tcagtcgcactagtcacgaccggtgctcgatttagagtgctacgaaggggaaagggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacggccacatacaactgacaagtccagccacagttntttaanacacaccctaacaataacaactacttaatgtatcanacaagtaagtagccagccctacagctactctattcgnggacactcggtaacccgggacgtcccggggtacctagaccgtactcgagtcggcgaggtccggtagtcggggactaaggtactttccgaccttcaccgaccctatcgacgctaccgccctacgacggactaaggaagtacgttgacggttacttaaggtttacttcgtagtacgacgtagagttattagttacgtagttacgttcggtacggtaccggttaccgggaaccgaagggaaccgtaaagggttacgaaaaccgtaaccgtaaaccggtaaggtcggtacggtaccgacgtaccgtacctaacgtccgtttacg

SEQ ID NO: 434436 - DNA, 505 bp, Homo sapiens
  misc_feature: GZ8MTXP01DO4CP.51.81.H04.1.454.CMB.2.raw
  modified_base (234)..(234): a, c, t, g, unknown or other
  modified_base (415)..(415): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggcccctgtgttggtgatgtaataaagacactgagaggccctcagggactcctgagcgattctctggctccaggtcaagggacaacgggtcacagttggccaatcagtggagtccaggcagaggacgtagctgactattattgtcaatcaanagacacatgtacttatgtcttcggaactgcacaggtcacgtcctgggttcacgacccgaaggccaaccccactcgttcaacttcgtcccg

SEQ ID NO: 434437 - DNA, 496 bp, Homo sapiens
  misc_feature: GZ8MTXP01DR56I.51.81.H04.1.454.CMB.2.raw
  modified_base (463)..(463): a, c, t, g, unknown or other
  modified_base (481)..(481): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggcaggcccctgtgtggtgatgtataaagacactgagaggccctcagggatcccgtgagcgattctctggctccaggtcaagggacaacggtcacattggccatcagtgagtccaggcagaggacgaggctgactatattgtcaatcaacagacaccattggtacttatgtcttggaactgcgacaaggtcaccgtctgggttcngcccaaggccaacccacngttcaacttcttccg

SEQ ID NO: 434438 - DNA, 501 bp, Homo sapiens
  misc_feature: GZ8MTXP01A8KOY.51.81.H04.1.454.CMB.2.raw
  modified_base (234)..(234): a, c, t, g, unknown or other
  modified_base (307)..(307): a, c, t, g, unknown or other
  modified_base (470)..(470): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggccaggcccctgtgttggtgatgtataaagacactgagaggccctnagggatccctgagcgattctcctggctccgaggtcaagggacaacggtcacattggccatcagtggagtccaggcagaggacgaggctgactatattgtacaatcaacagacacctattggtacttatgtcttcggaactgcgacaggtcacgtctgggttcngcccaaggccaacccactcgctcttcgtccg

SEQ ID NO: 434439 - DNA, 507 bp, Homo sapiens
  misc_feature: GZ8MTXP01A5DNX.51.81.H04.1.454.CMB.2.raw
  modified_base (232)..(232): a, c, t, g, unknown or other
  modified_base (415)..(415): a, c, t, g, unknown or other
  modified_base (471)..(471): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggtgatgtataaagacactgagaggccctgagggatccctgagcgattctcctggctccaggtcaagggacaacggtcacattggccatcagtggagtccaggcagaggacgaggctgacttattattgtacaatcaanagacacctattggtacttatgtcttcggaactgcgacaggtcaccgtctgggttcncgcccaaggcccaacccgatcgttcaacgttctccg

SEQ ID NO: 434440 - DNA, 507 bp, Homo sapiens
  misc_feature: GZ8MTXP01E31H3.51.81.H04.1.454.CMB.2.raw
  modified_base (237)..(237): a, c, t, g, unknown or other
  modified_base (328)..(328): a, c, t, g, unknown or other
  modified_base (395)..(395): a, c, t, g, unknown or other
tcagcgatcgtatacacgaccggtgctcgatttagtagtgtagattcgcggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccagccctgtgtggtgatgtataaagacactgagaggccctcagggatccctgagcgacttctntggctccgaaggtcaagggacaaacggtcacattggcatcagtggagtccaggcagaggacgaggcngactattatggtcaatcaacagacaccattggtacttatgtcttcggaatgcgaccaaaggtcaccgttccgttgggttcaacggcccaaggcccaacccactcgttcaacc

SEQ ID NO: 434441 - DNA, 500 bp, Homo sapiens
  misc_feature: GZ8MTXP01AYLT7.51.81.H04.1.454.CMB.2.raw
  modified_base (415)..(415): a, c, t, g, unknown or other
  modified_base (469)..(469): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtaataaagacactgagaggccctcagggatccctgagcgattctctggctccgaggtcaagggacaacggtcacattggccatcagtggagtccaggcaggaggacgaggctgactattatgtcaatcaaanagacacattggtacttatgtcttcggaactgcgacaaggtcacgtctgggttcngcccaagcccaacccgactgcaacttctccg

SEQ ID NO: 434442 - DNA, 498 bp, Homo sapiens
  misc_feature: GZ8MTXP01C40GR.51.81.H04.1.454.CMB.2.raw
  modified_base (233)..(233): a, c, t, g, unknown or other
  modified_base (466)..(466): a, c, t, g, unknown or other
  modified_base (482)..(483): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtaataaagacactgagaggcccctgagggatcccgtgagcgattctcctggctccgaggtcaagggacaacggtcacattggccatcagtgagtccagcagagacgaggctgactattatgtacaatcaaacagacacatgtacttatgtcttcggaactgcacaggtcacgtcctggttcngcccaagccaaccccnncgttcaacttctccg

SEQ ID NO: 434443 - DNA, 498 bp, Homo sapiens
  misc_feature: GZ8MTXP01EI99N.51.81.H04.1.454.CMB.2.raw
  modified_base (464)..(464): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtacagcagagcggcaggccctgtgtggtgatgtataaagacactgagaggccctcagggatccctgagcgattctcctggctccaggtcaagggacaacggtcacattggccatcagtggagtccaggcagaggacgaggctgactagttattgtcaatcaaacagacaccattggtacttatgtcttcggaactgcgacaaggtcacgtcctgggttcngcccaaggcccaaccccactgactaacttctccg

SEQ ID NO: 434444 - DNA, 525 bp, Homo sapiens
  misc_feature: GZ8MTXP01EU49F.51.81.H04.1.454.CMB.2.raw
  modified_base (235)..(235): a, c, t, g, unknown or other
  modified_base (487)..(487): a, c, t, g, unknown or other
  modified_base (506)..(506): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacacgtgagaggccctgagggatccgtgagcgattctcctggctccgaggtcaagggacaacggtcaacagttcggcctatcgagtggacgtccgaggcaggaggacgaggtctgacttagttattgacaagtcaacagacacctagttggtacttatgtcttcggactgcgacaaggtcacgtcgtgggttcncgcccgaacggccaacccnctgacctaacgttctcccg

SEQ ID NO: 434445 - DNA, 516 bp, Homo sapiens
  misc_feature: GZ8MTXP01BDC4W.51.81.H04.1.454.CMB.2.raw
  modified_base (217)..(217): a, c, t, g, unknown or other
  modified_base (233)..(233): a, c, t, g, unknown or other
  modified_base (414)..(414): a, c, t, g, unknown or other
  modified_base (497)..(497): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaacgntatgcttattggtaccagcagaagccggcaggcccctgtgtggtgatgtataaagacactgagaggccctcgagggatcccgtgagcgattctcctggctcgaggtcgaagggacaacggtcacagttcggccatcagtgagtccaggcagaggacgagctgactatatgtacaagtcaanagacacctattcggtacttatgtctacggaactgaacgaccaaggtccaccgtcctgggttacgcgacccaaggcccaacccnctcgcctaacttcgtcccg

SEQ ID NO: 434446 - DNA, 522 bp, Homo sapiens
  misc_feature: GZ8MTXP01DHG7J.51.81.H04.1.454.CMB.2.raw
  modified_base (236)..(236): a, c, t, g, unknown or other
  modified_base (416)..(416): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtataaagacactgagaggccctgagggatccctgagcgattctctggctccgaggtcaagggacaacggtcaacattggccatcagtgagtcagcagagacgaggctgactattatgtacaagtcaaanagacacctattggtacttatgtcttacggaactgaacgacaaaggtcaaccgtcgtgggttcacggcccaaggcccaaccccactcgttcctaacgttcttccccg

SEQ ID NO: 434447 - DNA, 557 bp, Homo sapiens
  misc_feature: GZ8MTXP01BSJQ8.51.81.H04.1.454.CMB.2.raw
  modified_base (438)..(438): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtacagcagaagccggcacggccctgtgtggtgatgtaataaagacactgagacggccctagagggatcccgtgagcgtattctccgtggctcgaggtcaaaggggacaacgggtcaacagttcggcctaagtcgaggtggagtccgaaggcaggaaggacgaggctagattattattagtacaaagtcaaanacgacactagttgtacttatgtcttacggaactgaaccgaaccttaagggtccaccgtccgtgggttaccacgaccccgaaaggccccaacccactcgttacctaaccttcgttccccg

SEQ ID NO: 434448 - DNA, 502 bp, Homo sapiens
  misc_feature: GZ8MTXP01D4Z35.51.81.H04.1.454.CMB.2.raw
  modified_base (234)..(234): a, c, t, g, unknown or other
  modified_base (306)..(306): a, c, t, g, unknown or other
  modified_base (463)..(463): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgttggtgatgtaataaagacactgagaggccctnagggatccctgagcgattctctggctcgagtcaagggacaacggtcacattggccatcagtgagtccgaggcagaggacgaggctgactattatgtcaatcaacagacacattgtactatgtcttcggaatgcacgaaggtcaccgtctgggttccngcccaaggccaaccccatcgacctaacgttccgttcccg

SEQ ID NO: 434449 - DNA, 487 bp, Homo sapiens
  misc_feature: GZ8MTXP01B135O.51.81.H04.1.454.CMB.2.raw
  modified_base (232)..(232): a, c, t, g, unknown or other
  modified_base (299)..(299): a, c, t, g, unknown or other
  modified_base (361)..(361): a, c, t, g, unknown or other
  modified_base (413)..(413): a, c, t, g, unknown or other
  modified_base (448)..(448): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcacctgctctggagatgcattgccaaacgntatgcttatggtaccagcagaagccggcagccctgtgtgtgatgtataaagacactgagaggccctnagggatcctgagcgattctctggctccaggtcaagggacaacggtcacatgccatcagtganccagcagagacgaggctgactattatgtcaatcaacagacacatgtactatntcttcggaactgcgacagtcacgtacctgggttcngcccaaggccaaccccactcgttactaacgttcttcccg

SEQ ID NO: 434450 - DNA, 506 bp, Homo sapiens
  misc_feature: GZ8MTXP01DLGJU.51.81.H04.1.454.CMB.2.raw
  modified_base (311)..(311): a, c, t, g, unknown or other
  modified_base (361)..(361): a, c, t, g, unknown or other
  modified_base (420)..(420): a, c, t, g, unknown or other
  modified_base (471)..(471): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgttggtgatgtataaagacactgagaggccctnagggatccctgagcgattctctggctcaaggtcaagggacaacggtcacnttggccatcagtggagtccgaggcaggaggacgaggctgactattattggtcaatcaanagacacctattggtacttatgtcttcggaactgcgacaaggtcacgttcgnggttcaagcccaaggcccacccactcgttctaacc

SEQ ID NO: 434451 - DNA, 495 bp, Homo sapiens
  misc_feature: GZ8MTXP01CGN8Q.51.81.H04.1.454.CMB.2.raw
  modified_base (233)..(233): a, c, t, g, unknown or other
  modified_base (411)..(411): a, c, t, g, unknown or other
  modified_base (462)..(462): a, c, t, g, unknown or other
  modified_base (480)..(480): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggcaggcccctgtgttggtgatgtataaagacactgagaggccctcagggatccctgagcgattctcctggctcgaggtcaagggacaacggtcacattggccatcagtgagtccagcagaggacgaggctgactattatgtacaatcaacngacaccattggtacttatgtctcgaactgcacaggtcaccgtctgggttcncgcccaaggccaacccancgttcaacttctccg

SEQ ID NO: 434452 - DNA, 540 bp, Homo sapiens
  misc_feature: GZ8MTXP01BYM44.51.81.H04.1.454.CMB.2.raw
  modified_base (235)..(235): a, c, t, g, unknown or other
  modified_base (425)..(425): a, c, t, g, unknown or other
  modified_base (493)..(493): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtaataaagacactgagaggccctgagggatcccgtgagcgattctccgtggctccgaggtcgaagggacaacggtcacattcggccatcagtggagtccgaggcaggaggacgaggctgactattatgtacaatcaaanagaacacctagttggtactttatgttcttacggactgcgaacagggtccaccgtccgtggggttaccncggacccgaaggccccaacccgactcgttacctaaccgttcttcccg

SEQ ID NO: 434453 - DNA, 488 bp, Homo sapiens
  misc_feature: GZ8MTXP01ECCSL.51.81.H04.1.454.CMB.2.raw
  modified_base (458)..(458): a, c, t, g, unknown or other
  modified_base (474)..(474): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggcaggccctgtgtggtgatgtaataaagacatgagaggccctgagggatccctgagcgattctctggctccaggtcaagggacaacggtcacattggccatcagtgagtccaggcagaggacgaggctgactattatgtcaatcaaacagacacattggtacttatgtcttggaactggcacaaggtcacgtctgggcngcccaaggccaacccntcgcaacttctccg

SEQ ID NO: 434454 - DNA, 521 bp, Homo sapiens
  misc_feature: GZ8MTXP01BZNZ1.51.81.H04.1.454.CMB.2.raw
  modified_base (235)..(235): a, c, t, g, unknown or other
  modified_base (422)..(422): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggcccctgtgttggtgatgtaataaagacactgagaggccctcgagggatcccgtgagcgattctcctggctccgaggtcgaagggacaacggtcacagttggccatcagtggagtccgaggcagaggacgaggctgactattattgtacaatcaaanagacacctattggtaacttatgtcttcggaactgaacacaaggtccaccgtcgtgggcacgccccaaggccccaacccatcgttctaaccttcgttccc

SEQ ID NO: 434455 - DNA, 515 bp, Homo sapiens
  misc_feature: GZ8MTXP01B6PYX.51.81.H04.1.454.CMB.2.raw
  modified_base (417)..(417): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccggcaggcccctgtgttggtgatgtataaagacatgagaggccctcagggatccgtgagcgattctcctggctccgaggtcaaagggacaacggtcacattcggccatcagtggagtccaggcaggaggacgaggctagactattattgtacaatcaanagacaccattggtacttatgtcttcggaactgcgaaccgaggtccaccgtcgtgggttcacgcccaaggcccaacccgatcgactaacgttcttcccg

SEQ ID NO: 434456 - DNA, 518 bp, Homo sapiens
  misc_feature: GZ8MTXP01BZIB1.51.81.H04.1.454.CMB.2.raw
  modified_base (233)..(233): a, c, t, g, unknown or other
  modified_base (277)..(277): a, c, t, g, unknown or other
  modified_base (479)..(479): a, c, t, g, unknown or other
  modified_base (502)..(502): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgttggngatgtataaagacactgagaggccctcgagggatccctgagcgattctctggctcgaggtcaagggacaacggtcacattcggccatcaagtggagtccaggcagaggacgaggctgactattatgtacaagtcaaacagacaccagttggtacttatcgtcttacggaactgcgaaccaagggtcaccgtccgtgggttcncgacccgaaggcccaaccccacngttcaacttcttcccg

SEQ ID NO: 434457 - DNA, 495 bp, Homo sapiens
  misc_feature: GZ8MTXP01D7QP8.51.81.H04.1.454.CMB.2.raw
  modified_base (235)..(235): a, c, t, g, unknown or other
  modified_base (304)..(304): a, c, t, g, unknown or other
  modified_base (402)..(402): a, c, t, g, unknown or other
  modified_base (409)..(409): a, c, t, g, unknown or other
  modified_base (429)..(429): a, c, t, g, unknown or other
  modified_base (457)..(457): a, c, t, g, unknown or other
  modified_base (475)..(475): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtaccagcagaagccggcaagcccctgtgtggtgatgtataaagacactgagaggccctnagggatcctgagcgattctctggctcgaggtcaagggacaacgggtcaacattggccatcagtggagtccaggcagaggacgaggctgactatattgnaatcaanagacacattgtacttatgtntcgaatgcacaggtcacgtctgggttcngcccaaggcccaacccgntcgttctaaccttcttcccg

SEQ ID NO: 434458 - DNA, 553 bp, Homo sapiens
  misc_feature: GZ8MTXP01CH7OU.51.81.H04.1.454.CMB.2.raw
  modified_base (244)..(244): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctcgtggagatgctattcgaccaaacgntatgcttattggtaccagcagaacggccggccacgccctgtgtggtgatgtaataaagacactgagacggccctagagggactccgtgagcgtacttctcgtggcctcgaaggtcgaagggacaacgggtcatgttcggaccatcgaggtggacgtccgaggcaggaggacgagctagaactattattggtacaatacaacagacacgtagttacgtattagtcgtcttcggaacttgacgaaccgttaaggtccacccgttccgttgggttcaacgacccgaacggcccaacccactcgttcctaacc

SEQ ID NO: 434459 - DNA, 544 bp, Homo sapiens
  misc_feature: GZ8MTXP01A7924.51.81.H04.1.454.CMB.2.raw
  modified_base (239)..(239): a, c, t, g, unknown or other
  modified_base (285)..(285): a, c, t, g, unknown or other
  modified_base (529)..(529): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggcaggcccctgtgttggngatgtataaagcactgagaggcccctgagggactcccgtgagcgtacttctcgtggctccgaagggtcaagggacaacgggtcacattcggccatcagtggatccgaggcaggaggacgaggctagacttagttatggtacaatcaaacagaccactagttaggtacttaagtcgtcttcggaacttgacgtaacaaggtccaacgttccgttgggttaccaacgccccaaggccccaaacccncgtcgttcctaaccg

SEQ ID NO: 434460 - DNA, 510 bp, Homo sapiens
  misc_feature: GZ8MTXP01DJ2AP.51.81.H04.1.454.CMB.2.raw
  modified_base (465)..(465): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggcaggccctgtgttgtgatgtataaagacactgagaggccctcagggatccctgagcgattctctggctccgaaggtcaaggggacaaacgggtcacattggccatcagtggagtccaggcaggaggacgaggctgactattattggtcaaatcaacagacacctattggtacttagtgtcttcggaactgcgacaaggtcnccgttcgttgggttcaagcccaaggcccacccgactcgttctaac

SEQ ID NO: 434461 - DNA, 505 bp, Homo sapiens
  misc_feature: GZ8MTXP01EABP3.51.81.H04.1.454.CMB.2.raw
  modified_base (237)..(237): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggccctgtgtgtgatgtataaagacactgagaggccctgagggatccctgagcgtacttctctggctccgaagggtcaaggggacaacgggtcacattggccatcagtggagtcaggcagaggacgaggctgactattattggtacaatcaacagacacattgtacttatgtctcggaactgcgacaaggtcacgttccgttgggttcaacgcccaacggcccaacccactcgctaacc

SEQ ID NO: 434462 - DNA, 492 bp, Homo sapiens
  misc_feature: GZ8MTXP01AZZ4V.51.81.H04.1.454.CMB.2.raw
  modified_base (308)..(308): a, c, t, g, unknown or other
  modified_base (411)..(411): a, c, t, g, unknown or other
  modified_base (461)..(461): a, c, t, g, unknown or other
  modified_base (479)..(479): a, c, t, g, unknown or other
  modified_base (482)..(482): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctggctccaggtcaagggacaacggtcacattggcatcagtgagtccaggcagaggacgaggctgacttatatgtcaatcaangacaccattggacttatgtcttggaactgcacaaggtcaccgtctgggcngcccaaggccaaaccccntcnctcttcgtcg

SEQ ID NO: 434463 - DNA, 562 bp, Homo sapiens
  misc_feature: GZ8MTXP01BZII4.51.81.H04.1.454.CMB.2.raw
  modified_base (235)..(235): a, c, t, g, unknown or other
  modified_base (508)..(508): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgttggtgatgtaataaagacactgagaggccctgagggactcccgtgagcgattctccgtggctcgaggtcgaagggacaacggtcacagttcggcctatcgagtggagtccaggcagaggacgaggctgactattatagtacaagtcaaacagacacctagttggtaacttagtgttcgttacggaacttgaacgaacccgttaaagggtccaccgttaccgtggggttacccncggaccccgaacggaccccaaacccctcgtcgttaccctaaccgttcttccccg

SEQ ID NO: 434464 - DNA, 525 bp, Homo sapiens
  misc_feature: GZ8MTXP01DIN03.51.81.H04.1.454.CMB.2.raw
  modified_base (233)..(233): a, c, t, g, unknown or other
  modified_base (405)..(405): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggccctgtgtggtgatgtataaagacactgagaggccctcagggatccctgagcgattctctggctcaggtcaagggacaacggtcacattggccatcagtgagtcagcagagacgagctgactagttatgtacaagtacaanaacgacacctagttggtacttaatgttcttcgaacttgcgacaaaggttccaaccgtccgtggggttccacggaccccgaaggaccccaaccccacgtcgttacctaacttccgttcccg

SEQ ID NO: 434465 - DNA, 496 bp, Homo sapiens
  misc_feature: GZ8MTXP01EB8QV.51.81.H04.1.454.CMB.2.raw
  modified_base (306)..(306): a, c, t, g, unknown or other
  modified_base (404)..(404): a, c, t, g, unknown or other
  modified_base (460)..(460): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgttggtgatgtataaagacactgagaggccctnagggatccctgagcgatctctggctcagtcaagggacaacggtcacattggccatcagtgatcaggcagaggacgagctgactattatgtcaatcaanagacacattggtacttatgtctggaactgaacgaccaaggtcacgtcctgggttcngacccaaggcccaacccactcgttcaacttctcccg

SEQ ID NO: 434466 - DNA, 505 bp, Homo sapiens
  misc_feature: GZ8MTXP01DYMQG.51.81.H04.1.454.CMB.2.raw
  modified_base (234)..(234): a, c, t, g, unknown or other
  modified_base (336)..(336): a, c, t, g, unknown or other
tcagcgatcgtatacacgaccggtgctcgatttagtagtgtagattcgcgggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatgtacagcagaagcggcaggccctgtgtggtgatgtataaagacactgagaggccctcagggatccctgagcgattctctggctccaagggtcnggggacaaacggtcacattggcatcagtggagtcaggcagaggacgaggctgactattattggtcaatcaacagacacatagtattatagtctcgaactgcgaccaaacgtacgaaccgttccgttcgggttcgaacgccaacggaccaaccccacctcgttcgtaacc

SEQ ID NO: 434467 - DNA, 575 bp, Homo sapiens
  misc_feature: GZ8MTXP01B65TW.51.81.H04.1.454.CMB.2.raw
  modified_base (234)..(234): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgttggtgatgtaataaagacactgagaggccctgagggactcctgagcgattctcctggctcgaggtcaagggacaacgggtcacattcggccatcgagtgagtccaggcaggaggacgaggctagactagttattgtacaagtcaaacagacacctagttggtactttaagtcgttacttacggaaacttgaaccgtaaccgttaacgggtcccaacccggttcccgttcgggggttaccacggaccccgaaacgggccccaaaccccgtacgtccgttacctaacccttcgtttcccccgg

SEQ ID NO: 434468 - DNA, 544 bp, Homo sapiens
  misc_feature: GZ8MTXP01AWXR8.51.81.H04.1.454.CMB.2.raw
  modified_base (281)..(281): a, c, t, g, unknown or other
  modified_base (443)..(443): a, c, t, g, unknown or other
  modified_base (461)..(461): a, c, t, g, unknown or other
  modified_base (534)..(534): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggcagccctgtgtggtnatgtataaagcactgagacggccctcgagggactcccgtgagcgattctctggcctccgaagggtccaaggggacaaacgggtcacagttcggaccatcagtggacgtccgaaggcaggacggacgaggctagacttaattattaggtacaaatcaaacaanaccactagttacgtattntacgtcttacggaactcgacgtaacgacggtcctaccggttcgttggaccaacgacccgaacgccccaacccnctcgttcctc

SEQ ID NO: 434469 - DNA, 630 bp, Homo sapiens
  misc_feature: GZ8MTXP01D56Z1.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggcaggatcacctgctctggagatgcattgaccaaacgatatgcttatggtaccagcagaagccgggcaggccctgtgttggtgatgtaaataaagacacgtgagacggccctagagggactcccgtgagcgattctccgtggactccgaggtcaaagggacaacggtcacgagttcggccaatcgagtggacgtccgaggcaaggaggacgtaggctagattagttatacgtacaagtcaaacaagaccactaagttggttaaccttaagtcgttacgtttaccgggaaacttggaacccgtaaccgttaaacgggttcccgttaaacccgggttcccgttgggggttaacccttacggaacccccgaaaccggggtacccccaaaaaccccctacggttacgttccctaaccctttcccgtttaacccccggg

SEQ ID NO: 434470 - DNA, 640 bp, Homo sapiens
  misc_feature: GZ8MTXP01CD98F.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgatatgtcttatggtaccagcagaagccggcacggccctgtgttggtgatgtaataaagacacgtgagacggccctgagggactcccgtaggacgcgtattctccgtggctccgaggtcgaaacgggacaacgggtcacgtagttcggaccctatcgaggtgggtacgtccgagggcgaaggacgggaacggagggctaggaacttattattgtactaagtacaaactagacctaacctagttaggttaacttagttcgttaccgttacgggtaaacttgggaaccgtaaccgttaaacgggtcccaacccgggtttccgtcgggggttacccaaccgggttaccccgaaacggggacccccaaaccccgtacgtccggttaccctaacccgttccgtttcccccg

SEQ ID NO: 434471 - DNA, 603 bp, Homo sapiens
  misc_feature: GZ8MTXP01ALDZ1.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacacgcccaccctcggtgtcagtcgtccccgaggacagacggccaggatcacctgctcgtggagatgctattcgacccaaacgatatgtcttagttcggtaccagcaaggaacggcccgggaccgacggcccctggtggttggtgagtagtaataaaggacacgtgagacggccctagagggactcccgtgacgcgtacttctcgtggcctaccgaaggtcgaacgggacaacgggtacacgtagttcggcctatcgagtggacgtccgaggcgaaggaggacgaggctagacttattattggacaatacaacgacgacactagttacggtacttagtcgttcgttacggaactggccgaaaccgttaacggtcctaaccggttcgttcgggttaccgaaccgacccgaacggaccccaaccccagtcgttccgtaacccg

SEQ ID NO: 434472 - DNA, 611 bp, Homo sapiens
  misc_feature: GZ8MTXP01CL0EK.51.81.H04.1.454.CMB.2.raw
  modified_base (224)..(224): a, c, t, g, unknown or other
  modified_base (300)..(300): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtgganatgctattcgaccaaacgatatgtcttattcggtaccagcaaggaacgcccgggaccacggccctggtggttggtnatgtaataaagacacgtagaggacggccctagagggtactcccgtgacgcgtactttcctcgtcggtcctacccggtaagggttcgaacgggggaacctaaaccgggtcaacgtagttcgggaccagtacgaggtgggacgtccgagggacgaaggacgggacgagggctagacttattagttggtactaaactcaaagacgaacctacctagtttacgtaacttagtgttccgttcggaactcgacgaaaccgacggtcaccggttcgttggacaaccgacccaacggcccaacccttatccgctaaccg

SEQ ID NO: 434473 - DNA, 539 bp, Homo sapiens
  misc_feature: GZ8MTXP01EKIQW.51.81.H04.1.454.CMB.2.raw
  modified_base (236)..(236): a, c, t, g, unknown or other
  modified_base (516)..(516): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagagccggcaggccctgtgtggtgatgtataaagcactgagaggccctgagggactccctgagcgattctcctggctccgaggtcaaagggacaacgggtcacgtattcggacctatcgagttgggacgtcccgagggcaggaggacgaggctagacttattattgtacaagttcaaacagacacctagttggttacttatgtcttacggactgcgacaaggtccaccgtcgtgggttcacgacccaacggcccaaccccgntcgttcctaacgttccgttcccg

SEQ ID NO: 434474 - DNA, 513 bp, Homo sapiens
  misc_feature: GZ8MTXP01EWX7F.51.81.H04.1.454.CMB.2.raw
  modified_base (234)..(234): a, c, t, g, unknown or other
  modified_base (414)..(414): a, c, t, g, unknown or other
  modified_base (469)..(469): a, c, t, g, unknown or other
  modified_base (491)..(491): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagagcggcagccctgtgtgtgatgtataaagacactgagacgccctcgagggactccctgagcgattctcgtggctccgagtcgaagggacaacggtcacattggccatcagtgagtccgaggcagaggacgagctgactatatgacaatcaaacagacactnttaggttacttagtgtcttacgactgcgtaacaggtccaccgtcgtcgggttacncgacccgaaggcccaaaccccntcgttactaaccgttcttcccg

SEQ ID NO: 434475 - DNA, 530 bp, Homo sapiens
  misc_feature: GZ8MTXP01DK1L4.51.81.H04.1.454.CMB.2.raw
  modified_base (439)..(439): a, c, t, g, unknown or other
  modified_base (490)..(490): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcaggcccctgtgttggtgatgtaataaagacactggagacggccctcgagggtactccccgtgacgcgtattctcgtcggctccgaggtcaaaggggacaacgggtcacagttcggccagtcgaggtgagtccgaggcaggaggacgaggctagactattattgtacaatcaanagacactatgtacttatgtctcggactgcgacgagtcacgtcgtgggttcncgacccaaggacccaacccgactcgttctaacttcgtccc

SEQ ID NO: 434476 - DNA, 524 bp, Homo sapiens
  misc_feature: GZ8MTXP01ES0P8.51.81.H04.1.454.CMB.2.raw
  modified_base (217)..(217): a, c, t, g, unknown or other
  modified_base (233)..(233): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaacgntatgcttatggtaccagcagaagccggcaggccctgtgttggtgatgtataaagacactgagaggccctgagggactccctgagcgattctcctggctcgaggtcaagggacaacggtcacattggccagtcagtggagtcgaggcaggaggacgaggctgactattattgtcaagtcaagacgacacctattgttacttaatgtcttcggaactgcgaaccaggtccaccgtcgtacgggttcacgcccaacggcccaaccccgactcgttcctaacgttccgttccccg

SEQ ID NO: 434477 - DNA, 504 bp, Homo sapiens
  misc_feature: GZ8MTXP01EALU5.51.81.H04.1.454.CMB.2.raw
  modified_base (305)..(305): a, c, t, g, unknown or other
tcagcgatcgtatacacgaccggtgctcgatttagtagtgtagattcgcggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggcaggccctgtgtggtgatgtataaagacactgagaggccctnagggatccctgagcgattctctggctccaaggtcaagggacaaacggtcacattggcatcagtggagtccaggcaggagacgaggctagactattattggtcaatcaacagacacattgtacttatgtcttggaaactgcgaccaaaggtcaacgttccgttgggttcaagcccaaggcccaacccactcgttctaacc

SEQ ID NO: 434478 - DNA, 529 bp, Homo sapiens
  misc_feature: GZ8MTXP01EMDWM.51.81.H04.1.454.CMB.2.raw
  modified_base (454)..(454): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggccctgtgttggtgatgtataaagacactgagaggccctgagggatccctgagcgacttctctggctcccgaagggtcaaggggacaaacgggtcacattcgggccatcaagtggaagtccgaggcaaggaggacgaggctgaactattattggtacaatacaacagacacattagtacttntgtcttggaactgacgaccaaagtcaccgttcgttgggttcaaggcccaacggcccaacccactcgttcctaacc

SEQ ID NO: 434479 - DNA, 648 bp, Homo sapiens
  misc_feature: GZ8MTXP01ANDJT.51.81.H04.1.454.CMB.2.raw
  modified_base (218)..(218): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgatatgcttatggtacagcagagccggccaggccctgtgttggtgatgtaataaagcactgagacgccctgagggactcccgtgacgcgtattcgtcgtggctccgaggtcaagggaaccaacggtcacgtattcggcctagtcaggtggacgtccgaggcgaaggagggacggaggcgtgtaacttagtttattagtacaaagttcaaacgtacgaacctaacccgtaagtttacgggttaaccttttaagttcggtttaccgtttaccgggtaaaccttcggaacccgtaaacccgttaaacggggttccccttaaacccgggttcccggtacgggttacccgaccggacccccgtaaacgggtcccccaaaccccgtacgtccgttaccctaaccgtttccctttaaccccg

SEQ ID NO: 434480 - DNA, 500 bp, Homo sapiens
  misc_feature: GZ8MTXP01DJCX4.51.81.H04.1.454.CMB.2.raw
  modified_base (304)..(304): a, c, t, g, unknown or other
  modified_base (408)..(408): a, c, t, g, unknown or other
  modified_base (428)..(428): a, c, t, g, unknown or other
  modified_base (460)..(460): a, c, t, g, unknown or other
  modified_base (491)..(491): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtcccaggacagacggccaggatcacctgctctggagatgcattgccaaaccgatatgcttattggtaccagcagaagccggcaggcccctgtgttggtgatgtataaagacactgagaggccctnagggatccctgagcgattctcctggctccaggtcaagggacaacggtcacattggccatcagtgagtccaggcagaggacgaggctgactatatgtcaatcaanagacacattgtacttatgtnttcggaactgcacaggtcaccgtctgggttcngaccccaaggcccaaccccgactcgttaccncttcttccg

SEQ ID NO: 434481 - DNA, 547 bp, Homo sapiens
  misc_feature: GZ8MTXP01CVM5D.51.81.H04.1.454.CMB.2.raw
  modified_base (235)..(235): a, c, t, g, unknown or other
  modified_base (497)..(497): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctggagatgcattgaccaaacgntatgcttatgtacagcagaagcggcaggccctgtgtggtgatgtaataaagacactgagacggccctgagggactccctgacgcgtattctcctggctcgaggtcaagggacaacggtcacagttggccatcagtgagtccgaggcaggaggacgaggctgactagttattgtacaagtcaaatagacaacctagttaggtacttatgttctttacggaacttgaacgtaaccgaaagggtccaaccgttccgtgggttacncggaccccgaacggaccctaaccccgactcgttcctaacgttccttcccg

SEQ ID NO: 434482 - DNA, 489 bp, Homo sapiens
  misc_feature: GZ8MTXP01DFVC9.51.81.H04.1.454.CMB.2.raw
  modified_base (217)..(217): a, c, t, g, unknown or other
  modified_base (418)..(418): a, c, t, g, unknown or other
  modified_base (462)..(462): a, c, t, g, unknown or other
  modified_base (476)..(477): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaagccggcaggcccctgtgtggtgatgtataaagacactgagaggccctcgagggatcccgtgagcgattctcctggctccgaggtcaagggacaacggtcacattggccatcagtgagtccaggcagaggacgaggctagactagttattgtacaatcaanagacacattgtactatgtctgactgcacagtcacgtctggttcngccaagccaacccnngctcgttctccg

SEQ ID NO: 434483 - DNA, 605 bp, Homo sapiens
  misc_feature: GZ8MTXP01AVEOD.51.81.H04.1.454.CMB.2.raw
  modified_base (219)..(219): a, c, t, g, unknown or other
  modified_base (236)..(236): a, c, t, g, unknown or other
  modified_base (278)..(278): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctgganatgcattgaccaaacgntatgcttatgtaccagcagaagccggcaggccctgtgttggngatgtaataaagacactgaggacgccctagagggactcccgtgacgcgtattctccgtggctccgaggtcgaagggaccaacggtcacgtagttcggacctatcgaggttggacgtccgaggcgaggagggacgaggtctagaacttattattgactaatacaacgacgaccaacctagttcggttaacttagtcgttccgttacggaacttcggaaccgtaaccgttaagggtcccacccggttccggtcggggttacccaccggaccccgaaaccgggccccaaaccccctgtacccgttccctaacctttcccggtttcccccg

SEQ ID NO: 434484 - DNA, 520 bp, Homo sapiens
  misc_feature: GZ8MTXP01DBN2P.51.81.H04.1.454.CMB.2.raw
  modified_base (417)..(417): a, c, t, g, unknown or other
  modified_base (477)..(477): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtacagcagaagcggcaggccctgtgttggtgatgtataaagacatgagaggccctgagggatccctgacgcgattctctggctccgaggtcaagggacaacggtcactagttcggccatcgagtggagtccgaggcaggaggacgaggctgacttatattgtcaagtcaanagacacattgtacttatcgtcttacgactgaacgaccaaggtccacgtccgtgggttacncgacccaaggcccaacccctatcgttcctaaccttcgttcccg

SEQ ID NO: 434485 - DNA, 510 bp, Homo sapiens
  misc_feature: GZ8MTXP01AH5PY.51.81.H04.1.454.CMB.2.raw
  modified_base (468)..(468): a, c, t, g, unknown or other
  modified_base (475)..(475): a, c, t, g, unknown or other
  modified_base (501)..(501): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccctgtgtggtgatgtataaagacactgagaggccctcgagggatccctgagcgattctctggctccgaggtcaagggacaacggtcacattggccatcagtggagtccgaggcaggaggacgaggctgacttattatgtacaagtcaaacagacaccagttgtacttatgtcttaggactgcgacaggtccacgtcgngggttcncgcccaacggccaacccactcgttcncttctcccg

SEQ ID NO: 434486 - DNA, 537 bp, Homo sapiens
  misc_feature: GZ8MTXP01A6194.51.81.H04.1.454.CMB.2.raw
  modified_base (233)..(233): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatgtaccagcagaagccggcaggcccctgtgttggtgatgtataaagacactgagacggccctcgagggatcccgtgagcgattctcctggctccgaggtcaagggacaacggtcacattggccatcagtgagtccaggcagaggacgagctgactattatgtacaatcaacagacacctattggtacttatcgtcttacgggaactcggcgtaaccgaagggtccaacccggtccgtggggttaccacggaccccaacgggccccaacccacgtcgttacctaacgttccttcccg

SEQ ID NO: 434487 - DNA, 499 bp, Homo sapiens
  misc_feature: GZ8MTXP01AJK2T.51.81.H04.1.454.CMB.2.raw
  modified_base (234)..(234): a, c, t, g, unknown or other
  modified_base (413)..(413): a, c, t, g, unknown or other
  modified_base (417)..(417): a, c, t, g, unknown or other
  modified_base (465)..(465): a, c, t, g, unknown or other
  modified_base (482)..(482): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctggagatgcattgccaaacgntatgcttattggtaccagcagaagccggcaggcccctgtgtggtgatgtataaagacactgagaggcccctgagggatcccgtgagcgattctcctggctccaggtcaagggacaacggtcacattggccatcagtggagtccgaggcaggaggacgtaggctgactattatgtcaatnaacngacaccatggtactatgtctcggactgcgacaggtcaccgtctgggcncgcccaaggcccaaccnctcgcaacttcgtcccg

SEQ ID NO: 434488 - DNA, 561 bp, Homo sapiens
  misc_feature: GZ8MTXP01BWK3U.51.81.H04.1.454.CMB.2.raw
  modified_base (234)..(234): a, c, t, g, unknown or other
  modified_base (412)..(412): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgttggtgatgtataaagacactgagagcctcagggatcctgagcgattctctggctccgaggtcaagggacaacggtcaacattggccatcagtgagtccaggcagaggacgaggctgactattattgtacaatacaaanagacaccattggtacttatgtcttcggaaacttggaaccgaaccgttaaacgggttccaacccggtcccgttcgggggttaccacggaccccgaaacgggaccccgaaacccccgtaactcggttaccctaacccgttctttcccccgg

SEQ ID NO: 434489 - DNA, 514 bp, Homo sapiens
  misc_feature: GZ8MTXP01DCRYX.51.81.H04.1.454.CMB.2.raw
  modified_base (233)..(233): a, c, t, g, unknown or other
  modified_base (275)..(275): a, c, t, g, unknown or other
  modified_base (415)..(415): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagcggcaggccctgtgttggngatgtaataaagacactgagaggccctgagggatcccgtgagcgattctccgtggctcgaggtcaaggggacaacggtcacattggccatcagtgagtccgaggcagaggacgtaggctagactattatgtacaatcaanagacactattgtacttatgtctacggactgaacgaccaaggtccaccgtcctgggttcacgcccaaaggcccaacccactgacctaacgttcgttcccg

SEQ ID NO: 434490 - DNA, 497 bp, Homo sapiens
  misc_feature: GZ8MTXP01D0ZZQ.51.81.H04.1.454.CMB.2.raw
  modified_base (309)..(309): a, c, t, g, unknown or other
  modified_base (466)..(466): a, c, t, g, unknown or other
  modified_base (481)..(482): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccgggcaggcccctgtgttggtgatgtaataaagacactgagaggccctnagggatcctgagcgattctctggctccaggtcaagggacaacggtcacattggccatcaagtggagtccaggcagaggacgaggctgactatattgtcaatcaacagacacattggtacttatgtcttacgactgcgacaggtcacgtctgggttcngcccaagccaacccnngttcaacttctcccg

SEQ ID NO: 434491 - DNA, 545 bp, Homo sapiens
  misc_feature: GZ8MTXP01DG52U.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccggcaggccctgtgtggtgatgtataaagacactgagaggccctgagggactccctgagcgtacttctctggctccgaagggtcaagggacaacggtcacatggccatcagtggagtccaggcaaggaggacgagggctagacttattattggtacaatacaaacgagaaccacctatttacggtactttagtgtcgttacggaactggaccgaaccgaaggtccaccgttccgttgggttccaacgacccgaacggccccaacccgactcgttcctaacccg

SEQ ID NO: 434492 - DNA, 508 bp, Homo sapiens
  misc_feature: GZ8MTXP01CAK8N.51.81.H04.1.454.CMB.2.raw
  modified_base (235)..(235): a, c, t, g, unknown or other
  modified_base (491)..(491): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggcaggcccctgtgttggtgatgtataaagacactgagaggccctcgagggatccctgagcgattctcctggctccgaggtcaagggacaacggtcacattggccatcagtgagtccaggcaggaggacgaggctgactattattgtacaagtcaaactagacacattggtacttatgtctaggaactgcgacaaggtcaccgtctggttcgcgcccaaggcccaacccntcgctaacttcttcccg

SEQ ID NO: 434493 - DNA, 561 bp, Homo sapiens
  misc_feature: GZ8MTXP01C66CI.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgcttattggtacagcagaagccgggccacggcccctgtgttggtgatgtaataaagacactgagacggccctgagggactccctgagcgtacttctcgtggcctccgaagggtcaaggggacaacgggctttttacagttcgggacatcgaggtggacgtccgaggcgaaggacgggacgaggctgtactattattggtacaatacaacagaccacctagttacgtacttatgtcgttcggaacttgaccgtaccaaggttccaaccggttccgttggttcaacgacccgaacggacccacccgactcgttctaaccc

SEQ ID NO: 434494 - DNA, 517 bp, Homo sapiens
  misc_feature: GZ8MTXP01BW9SR.51.81.H04.1.454.CMB.2.raw
  modified_base (234)..(234): a, c, t, g, unknown or other
  modified_base (495)..(495): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacatacggccaggatcacctgctctggagatgcattgccaaaccgntatgcttattggtaccagtagaagccgggccaggcccctgtgttggtgatgtataaagacactgagaggccctcagggatccctgagcgattctctcggctcaggtcagggaacaacgggtcacattggccatcagtggagtccaggcagaggacgaggctgactattattgtcaatcaacagacaccattggtacttatgtcttcggaactgcgaaccaaggttcaccgttcgtgggtcacgcccacggcccaaaccccnctgtccactccttcgttccccc

SEQ ID NO: 434495 - DNA, 514 bp, Homo sapiens
  misc_feature: GZ8MTXP01BT3M9.51.81.H04.1.454.CMB.2.raw
  modified_base (233)..(233): a, c, t, g, unknown or other
  modified_base (302)..(302): a, c, t, g, unknown or other
  modified_base (420)..(420): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagagccgggcaggccctgtgttggtgatgtataaagcactgagaggccctnagggatcctgagcgattctcctggctccgaggtcaaggggacaacgggtcacattcgggcctagtcagtggagtccgaggcagaggacgaggctgactattattgtacaagtcaaacngacaccattggtacttagtgtcttacgaactgaacgacaggtcacgtcgtgggttcacgcccaaggcccaacccgctcgttcaacttcttcccg

SEQ ID NO: 434496 - DNA, 544 bp, Homo sapiens
  misc_feature: GZ8MTXP01DFBWJ.51.81.H04.1.454.CMB.2.raw
  modified_base (434)..(434): a, c, t, g, unknown or other
  modified_base (495)..(495): a, c, t, g, unknown or other
  modified_base (519)..(519): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtacagcagagccggcaggccctgtgtggtgatgaataaagacatgagacggccctgagggactcccgtgagcgtattcctccgtggctccgaggtcgaaaggggaaccaacgggtcaacgtagttcggccatcgaggtggagtccgaggcaggaggacgaggctgactattattgtacaagtacaanagacactagttgtacttatcgttactcgaactgaacgacaggtccaccgtcgtgggttacncgaccccgaacggccccaaccccncgtcgttacctaaccttcgttcccg

SEQ ID NO: 434497 - DNA, 520 bp, Homo sapiens
  misc_feature: GZ8MTXP01CM0QK.51.81.H04.1.454.CMB.2.raw
  modified_base (234)..(234): a, c, t, g, unknown or other
  modified_base (382)..(382): a, c, t, g, unknown or other
  modified_base (478)..(478): a, c, t, g, unknown or other
  modified_base (499)..(499): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattgtaccagcagaagccggccaggcccctgtgttggtgatgtataaagacactgagaggccctcgagggatccctgagcgattctcctggctcaggtcaagggacaacggtcacagttcgcatcagtgagtccaggcagnggacgaggctgactattatgtacaagtcaaacagacacctattggtacttaatgtcttacggaactgaacgaacgaaggtcaccgtactgggttcngaccccgaaggcccaaccccnctcgttcctaacgttctcccg

SEQ ID NO: 434498 - DNA, 539 bp, Homo sapiens
  misc_feature: GZ8MTXP01DZRMG.51.81.H04.1.454.CMB.2.raw
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttatggtaccagcagaagccggcaggccctgtgtggtgatgtataaagacactgagaggccctgagggatccctgagcgtacttctcgtggctccgaagggtcgaagggacaacgggtcacattcggcatcagtggagtccgaggcaaggaggacgaggctgactattattggtacaatcaacagacacattagtacttatgtcttcggaaatcgacgaccgaaggtccaccgttcgttcggggttaccaacggaccccgaacggaccccaaccccttacgtcgttcctaacccg

SEQ ID NO: 434499 - DNA, 623 bp, Homo sapiens
  misc_feature: GZ8MTXP01EO7E2.51.81.H04.1.454.CMB.2.raw
  modified_base (238)..(238): a, c, t, g, unknown or other
  modified_base (255)..(255): a, c, t, g, unknown or other
  modified_base (281)..(281): a, c, t, g, unknown or other
  modified_base (574)..(574): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctcgtggagatgcattcgaccaaacgntatgcttatggtacagnagaagccggcacggccctgtgttggngatgtaataaagacactgagacggccctagagggactccgtgacgcgtattctccgtggctccgaggtcgaaacgggaactaacggtcaactagttcggacctagtcgaaggtggacgtccgagggcgaaggaggaaccggaggtactaggtaacttaagtttagttacgtactaaagtacaaactaacgaacctacctaagtttacggttaactttaagtcgttaccggtttacggaaaccttcggtaaccgaaccgttaaacggtccgttaacccgtcggtcgggttaccncggaccccaacggccccaacccgtactcgacctaaccttcttaaccccg

SEQ ID NO: 434500 - DNA, 598 bp, Homo sapiens
  misc_feature: GZ8MTXP01BW52R.51.81.H04.1.454.CMB.2.raw
  modified_base (218)..(218): a, c, t, g, unknown or other
  modified_base (235)..(235): a, c, t, g, unknown or other
  modified_base (281)..(281): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttattggtacagcagaacgccggccaggcccctgtgttggngatgtataaagacactgagacggccctcgagggactcccgtgagcgtattctccgtggctccgaggtcgaaagggacaacgggtcagtagttcggcagtcagtggacgtccgaggcgaggaggaccgaggctagacttattacgttagtacaagtcaaacagaccaacctagttacggtactttaagttcgtaccgtttacggaaacttggaaccgtaacgacggttaccgaaccgttcccgtaggggttaccacggccccgtaaacgggccccaaaccccgtacggttccgttacctaaccttcccgtttccccgg

SEQ ID NO: 434501 - DNA, 606 bp, Homo sapiens
  misc_feature: GZ8MTXP01CK2CN.51.81.H04.1.454.CMB.2.raw
  modified_base (218)..(218): a, c, t, g, unknown or other
  modified_base (236)..(236): a, c, t, g, unknown or other
  modified_base (445)..(445): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagtcaccctcggtgtcagtgtccccaggacagacggccaggatcacctgctctgganatgctattgaccaaacgntatgtcttattggtaccagcagaacgccgggccaggcccctgtggttcggtgactagtataaagacacgtgagacggcccgtgagggactcccgtgagcgtattcgtcctggctcgaggtcgaaagggacaacggtcacgacgttggccaatcagtgagtccgaggcaggaggacgaggctagacttattattagtacaacgttcaaanacgaacacctagttcggtaatttaacgtcgtcgttacggtaactggaacgtaaccgaaggggttcccgaaccggttacccgtgggttaccgaaccggttaccccgtaacgggaccccctaaaccccgccgttcgttacccgtaacccgttcgtttccccgg

SEQ ID NO: 434502 - DNA, 521 bp, Homo sapiens
  misc_feature: GZ8MTXP01BOFYQ.51.81.H04.1.454.CMB.2.raw
  modified_base (239)..(239): a, c, t, g, unknown or other
  modified_base (280)..(280): a, c, t, g, unknown or other
  modified_base (510)..(510): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagaagccggcaggccctgtgtgngatgtataaagcactgagaggccctgagggactcccgtgagcgtattctcgtggctccgaagggtcaagggacaacgggtcacattcggccatcagtggagtccgaggcaaggaggacgaggctgactattattggtacaatcaaacagacaccgtattaggtacttatcgtcttggaaactgcgacgaagtcaaccgttcgttgggttcaagcccaaggcccaacccgntcgttctaacc

SEQ ID NO: 434503 - DNA, 548 bp, Homo sapiens
  misc_feature: GZ8MTXP01CCFDS.51.81.H04.1.454.CMB.2.raw
  modified_base (221)..(221): a, c, t, g, unknown or other
  modified_base (237)..(237): a, c, t, g, unknown or other
  modified_base (276)..(276): a, c, t, g, unknown or other
  modified_base (392)..(392): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttatggtaccagcagagcggcagccctgtgtggnatgtataaagcactgagacggccctgagggatccctgagcgtacttctcgtggctccgaaggtcaaggggacaacggtcactattcggcatcagtggagtccaggcaggaggacgngctgactattatggtactaatcaacagacctaccagtttcggtacttatgttcttacggaaacttcgacgaaccgttaggtcctaacccggttcgttcggggttaccaacggccccgaaacgggccccaaccccgacgttccgttaactaaccccg

SEQ ID NO: 434504 - DNA, 585 bp, Homo sapiens
  misc_feature: GZ8MTXP01EI3MK.51.81.H04.1.454.CMB.2.raw
  modified_base (276)..(276): a, c, t, g, unknown or other
  modified_base (440)..(440): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagagccggcaggccctgtgtggngatgtaataaagacatgagacggccctgagggactcccgtgacgcgattctcctggctccgaggtcgaaaggggacaacgggtcaacgtagttcggacctatacgagtggacgtccgaggacgaggagggaacgaggctagacttattatagtacaagtcaaanacgacactagttaggttacttagttcgtcgttacggaactggaaccgaccgttaaaggtccttaaccggtccgtacggggttaccacggacccgaaacggaccccaaaccccgtctcggttacctaaccgttcccgttaaccccg

SEQ ID NO: 434505 - DNA, 602 bp, Homo sapiens
  misc_feature: GZ8MTXP01EJCVB.51.81.H04.1.454.CMB.2.raw
  modified_base (239)..(239): a, c, t, g, unknown or other
  modified_base (417)..(417): a, c, t, g, unknown or other
tcagcgatcgtatacacgaccggtgctcgatttagtagtgtagattcgcgggggctggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggccctgtgtggtatgtataagacatgagagccgcaggagtacctgagcgattccttctcggcgtccacggtaacgacgggaacggaacgtacgacagttggccgatacagtaggacgtacgacggacgagaagggacggaggacggtntagtaatttaattcgttacgaaactacaaacaacgaacaaccctacgtttaggttaacgtttattagttcgtttacggtaacgtaacgtcgaaccgtaacggttaccgtaaccggtcccgttcgggttccgacgcccgaaaccgggaacccgtaaccccaccttcgtaaccgttaaccttccccg

SEQ ID NO: 434506 - DNA, 523 bp, Homo sapiens
  misc_feature: GZ8MTXP01ELE2D.51.81.H04.1.454.CMB.2.raw
  modified_base (234)..(234): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggcaggcccctgtgttggtgatgtaataaagacactgagaggccctcgagggatccctgagcgattctcctggctcgaggtcgaaagggacaacggtcaacgattcggccatcgagtggagtccgaggcaggaggacgaggctgacttattattgtacaagtcaaacagacacctagttgtacttatgtctacgactgcacaggtcaccgtcgtgggttcacgcccgaacggcccaaccccgctcgacctaacgttcttcccg

SEQ ID NO: 434507 - DNA, 518 bp, Homo sapiens
  misc_feature: GZ8MTXP01DQ6GF.51.81.H04.1.454.CMB.2.raw
  modified_base (309)..(309): a, c, t, g, unknown or other
  modified_base (470)..(470): a, c, t, g, unknown or other
  modified_base (487)..(487): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccgggccaggcccctgtgtggtgatgtataaagacactgagaggccctnagggatccctgagcgattctctggctccgaaggtcaaggggacaacgggtcacagttggccatcagtggagtccaggcaggaggacgaggctagactattattaggtacaaatcaaacagacacctattagtacttatgtctggaactgcgaccaaggtcnccgttcgttgggttacngacccaacggcccaacccactcgttctaacc

SEQ ID NO: 434508 - DNA, 628 bp, Homo sapiens
  misc_feature: GZ8MTXP01DZ53F.51.81.H04.1.454.CMB.2.raw
  modified_base (239)..(239): a, c, t, g, unknown or other
  modified_base (282)..(282): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctggagatgcattgaccaaaacgntatgcttatggtaccagcagaacgccggcacgccctgtgttgnatgaataaagcactgagacggccctgagggactccctggacgtcgtacttctacgtggcctccgaaaggtcgaaggaccgaaacggtcacgtagttcggccaatcgaggtggacgtccgaagggcgaaggacgggaacgagggtcctagtaacttattagttaggtactaaatacaaacgtaacgaacctacctaagtttacggtaaccttagtcgttcgttaacggaaacttcggaccgtaaccgttaacggtaccctaaccccggttccgttcgggacccgaacgggacccccgtaaacgggaacccccaaaacccccttcggtaacccgttcccgtaaccccg

SEQ ID NO: 434509 - DNA, 755 bp, Homo sapiens
  misc_feature: GZ8MTXP01CWB87.51.81.H04.1.454.CMB.2.raw
  modified_base (229)..(229): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccacctcggtgtcagtcgtcccaggacagacgcagatcactgctctggagatgcattcgacaaacgntatgcttatgtacagcagagcggcagccctgtgtgtgatgtaataaagacactgagacggcctgagggactccgtagacgacgtattctccgtcgggtctccgtacgggtacgaaacgggggaaccgtaaccgggttcaaacgtaacgtttacggggacccaagttaccgaaaggggttcggtaacgggtaccccgaaaggggaccggaacgggtaaaggggaaccgggaaacggggtacgttaacgtaaacgtttaaagtttaacgttacgttaaacctaaacgtaaacggaaaccgtaaaccgtaaaccgtaaaccgttaaagtttaacggtttaactttaacgttacggttaccggttaacggtaaacgttaccggaaccggtaaacccggttaaacgggttaccccgttaacccgggttaccggttacgggttaaccgaacccggaaccccggaaaacccggtaacccccgtaaaccccgtaacgttacccgttacccttaacccgtttcccgttaaccccg

SEQ ID NO: 434510 - DNA, 527 bp, Homo sapiens
  misc_feature: GZ8MTXP01DWJDF.51.81.H04.1.454.CMB.2.raw
  modified_base (277)..(277): a, c, t, g, unknown or other
  modified_base (324)..(324): a, c, t, g, unknown or other
  modified_base (416)..(416): a, c, t, g, unknown or other
  modified_base (517)..(517): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtacagcagaagccggcagccctgtgtgtnatgtataaagcactgagaggccctgagggatccctgagcgtattctntggcctcgaagggtcaaggggacaaacgggtcaactagttgggccaatcgaagtggacgtccaggcaaggaggacgaggctagacttaattnttaggtactaaatcaaagagacacctattacggtacttatgtcttggaaacttgcgtacgaaggtcacgttccgttgggccaagacccaagccccaaccgntcgctaaccc

SEQ ID NO: 434511 - DNA, 605 bp, Homo sapiens
  misc_feature: GZ8MTXP01D5635.51.81.H04.1.454.CMB.2.raw
  modified_base (286)..(286): a, c, t, g, unknown or other
  modified_base (322)..(322): a, c, t, g, unknown or other
  modified_base (572)..(572): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggataacctgctctggagatgctattcgaccaaaaccgatatgtcttattggtaccagcagaagccgggccaggccctgtgttggtnatgtataaagcactgagacggccctgaggactcccngagcgtattctctcggcctcgaggtcgaagggaaccaacgggtcactattcgggccattcgaggttgacgtccgaggcgaggaggacgaaggctgaacttattattgtaacaatacgaaacagtaacctaaccgtagtttggtaacctttagttacgttccgtttacggaaactttcggaccgtaaacccgtaaagggttcctaacccggttcgtacggggttccaacgcccaaacggccccaaaccccncgttactccaccttaaccttccgtttaaccccc

SEQ ID NO: 434512 - DNA, 547 bp, Homo sapiens
  misc_feature: GZ8MTXP01CWCVS.51.81.H04.1.454.CMB.2.raw
  modified_base (280)..(280): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtacagcagaagccggcaggccctgtgttggnatgtaataaagacactgagaggccctgagggatcctgagcgtacttcctcgtggctccgaaggtcaagggacaacggtcactagttcggaccatcagtggacgtcgaggcaagagggacgaggctagactaagttatgtacaatcaacagacacgtattacggtacttatgtcttggaaactggttaccgaacgttaaacggtcaaccgttcccgttggggttaccaacggaccccaagggccccaaccccagtcgttaacctcccg

SEQ ID NO: 434513 - DNA, 676 bp, Homo sapiens
  misc_feature: GZ8MTXP01CNDCI.51.81.H04.1.454.CMB.2.raw
  modified_base (220)..(220): a, c, t, g, unknown or other
  modified_base (238)..(238): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctggaggcctcctatgagctgacacagccaccctggtgtcagtcgtccccaggacaggacggccaggatcacctgctctgganatgcattgaccaaaacgntatgtctttagttggtaccagacagaacggccggccacggccctgtgtggtgtatagtaataaagacacgtagagacgccctagagggtactccgtgacgacgtattctcgtcggctcgaggtacgaaagggtaaccaacggtcaacgtaagttcggacctagtacgaagggttcggaacgtacccgaagggaccgaagggacggggtaaccggaaggtccgtaaggtaaccttaatttacgttaggtaacaaacgttaacaaaacgaacgtaccaaaccgttagtttacggttaactttaagttcgttaccgttacggtaaccgttggaacccgtaaacgttaacgggtcccttaccggttaccccgtggggttacccacggaccccgaaacggccccctaaaccctcgtacgttacctaacccttcgttaaccccg

SEQ ID NO: 434514 - DNA, 621 bp, Homo sapiens
  misc_feature: GZ8MTXP01CWSMO.51.81.H04.1.454.CMB.2.raw
  modified_base (236)..(236): a, c, t, g, unknown or other
  modified_base (279)..(279): a, c, t, g, unknown or other
  modified_base (331)..(331): a, c, t, g, unknown or other
tcagcgatcgtatacacgaccggtgctcgattttagtagtgtagattcgcgggggtgggtccaggaggcagaactctgggtgtctcaccatggcctggatccctctacttctcccctctcactctctgcacaggctctgaggcctcctatgagctgacacagccaccctcggtgtcagtgtccccaggacaggacggccaggatcacctgctctggagatgcattcgaccaaacgntatgtcttatggtacagcagaagccggcaggccctgtgttggnatgtaataaagcactggagaggccctgagggtactccgtgagcgtattctcnggctcgaggtcaaaggggacaacgggtcaacgagttcggacctaatcgaggtggacgtccgaagggcaggaaggaacgagggctaggaacttattattagtacaaagttacaaacgagaacctaacctagtttcggtaacctttaagtcgttaccgttacgggtaaacttggaaccggaaaccgttaaagggttcccaaccggttaaccggtcggggttaccgacggaccccgaaagggttaccccaaaccccgtacgttcggttaccctaaccgttcctttaaccccgg

SEQ ID NO: 434515 - DNA, 580 bp, Homo sapiens
  misc_feature: GZ8MTXP01DXIV5.51.81.H04.1.454.CMB.2.raw
  modified_base (236)..(236): a, c, t, g, unknown or other
  modified_base (276)..(276): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtacagcagagccggcagccctgtgtggtnatgtaataaagacagtgagacggccctgagggactcccgtgagcgtattcctctggctccgaggtcgaacggggacaacgggtcactaagttcggaccagtcgaggtgagtccgagggcaggaggacgagctgacttattattagtacaatcaaacagaactacctagtttcggttaacttaagtcgttacgttacggaaacttcggaaccgtaaccgaacggttccgttaacccgtcgtacgggttaccgacggaccccgaacggaccccaaccctactcgttacctaaccttcgtttccccg

SEQ ID NO: 434516 - DNA, 565 bp, Homo sapiens
  misc_feature: GZ8MTXP01C4LF4.51.81.H04.1.454.CMB.2.raw
  modified_base (432)..(432): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgcattgaccaaacgatatgcttattggtaccagcagaagccggcacggccctgtgttggtgatgtaataaagacactgagacggccctgagggatcccgtgacgcgtattctccgtggctccgaggtcgaagggaacaacggtcaactagttcggaccagtcgagtggacgtccgaggcagaggacgaggctgactattatgacaatcaaangaacactagtgtacttatgtcgttacggaacttgaacgtaaccgttaaaggtccgaaccgttcgtcggggttaccacggccccgaaaccgggacccaaccccacgttcgttacctaaccgttcgttcccccgg

SEQ ID NO: 434517 - DNA, 647 bp, Homo sapiens
  misc_feature: GZ8MTXP01A4EC0.51.81.H04.1.454.CMB.2.raw
  modified_base (234)..(234): a, c, t, g, unknown or other
  modified_base (276)..(276): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggccctgtgtggngatgtaataaagacactgagacggccctagagggactcccgtagacgcgtattctcctggctccgaggtcgaaacgggaaccaacgggttacaacgtaacgttcgggaccaagttaccgaaaggttcgggaacgttcccgaaggggacccgaaagggaggggaacccggtaaagggtccgttagggtaaacctttaaggtttaagtttacgttaaccgtaaaacggtttacgaaaacctaacggaaaccctaaccgtaagtttacggtaactttaacgttgttaccgtttacggaacttcgaacgtaaccgacgtcaccgtccgtggacgcgaccaacggcccaacctctcgttactaaccgttctccccg

SEQ ID NO: 434518 - DNA, 535 bp, Homo sapiens
  misc_feature: GZ8MTXP01A9QMZ.51.81.H04.1.454.CMB.2.raw
  modified_base (237)..(237): a, c, t, g, unknown or other
  modified_base (309)..(309): a, c, t, g, unknown or other
  modified_base (329)..(329): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggccaggcccctgtgttggtgatgtataaagacactgagagccctnagggatccctgagcgattcntggctccgaaggtcaagggacaacgggtcacattggcatcagtggagtccaggcagaggacgaggctgactattatggtcaatcaacagacacattaggtacttagtgtcttcggaacttgacgaaccgaaggtccaacccggttccgttggggttaccaacggaccccgaacgggcccctaaccccgacttcgttccgtaacccg

SEQ ID NO: 434519 - DNA, 606 bp, Homo sapiens
  misc_feature: GZ8MTXP01D9F2G.51.81.H04.1.454.CMB.2.raw
  modified_base (237)..(237): a, c, t, g, unknown or other
  modified_base (415)..(415): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtccagtgtccccaggacagacggccaggatcacctgctctggagatgcattgaccaaaccgntatgcttatggtaccagcagaagccggcaggccctgtgttggtgatgtaataaagacactgaagacgccctagagggactccgtgacgcgtattctcgtcggtctccgaggtcgaaaggggacaacgggtcaactagttcggaccatcaaggtggataccgaggacaggaggaacggngtcgtagtaacttattagttacgtaactaaacgtaacaaacgaacgtaactaacgttagtttacggttaactttacgttcgttaccgttacgtaacgtcgaaccgtaacgttaacggtcccgttaccgtccggtcggaccgccgacccgaaccgaccccaacccgtcgtcgttacctccgttccgttcccg

SEQ ID NO: 434520 - DNA, 660 bp, Homo sapiens
  misc_feature: GZ8MTXP01BTZNX.51.81.H04.1.454.CMB.2.raw
  modified_base (221)..(221): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaacgatatgcttattggtacagcagaagccggcaggccctgtgttggtgatgtaataagacactgagacggccctcgagggactcccgtgacgcgtacttctcgtggtcctccgaagggtacgaacggggaaccgtaaaccggtccactagttcgggaccctagtcaggtgggaacgtcccgaagggacgaaagggacgggaacggacgggacctaggtaaacttaagttaacgtttgggtaacaaagttaccaaacgaacgaaaccacccttaagtttacggttaacctttagttacgttaccgttacggtaaacgttcgaccggtaaaccgttaacggtaccgtacccggttccgttcggggttacccaacggaccccgaaccggaccccaaaccccgttacgttaaccgttccgttaaccccg

SEQ ID NO: 434521 - DNA, 560 bp, Homo sapiens
  misc_feature: GZ8MTXP01APMDM.51.81.H04.1.454.CMB.2.raw
  modified_base (280)..(280): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggcaggcccctgtgttggngatgtataaagacactgagaggccctcaggggactccctgagcgattctccgtggctccaggtcaagggacaacggtcacattggccatcagtggagtccaggcaggaggacgaggctgactattatgtacaagtcaacagaccaacctagttggtaactttagtgttcttcggaaacttggaaccgaaccgttaagggtccaacccggtccgtcggggttaccacggccccgaagggccccaaacccgactcggttacctaaccttccgtttaaccccg

SEQ ID NO: 434522 - DNA, 535 bp, Homo sapiens
  misc_feature: GZ8MTXP01ERKQG.51.81.H04.1.454.CMB.2.raw
  modified_base (234)..(234): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggataacctgctctggagatgcattgccaaacgntatgcttatggtacagcagaagccggccaggcccctgtgttggtgatgtataaagacactgagaggccctcagggatccctgagcgattctctcggctcgaggtcaggaacaacggtcacattggccatcagtggatccgaggcagagacgaggctgactattatgtacaatcgaacagaacaccaattgtaacttagtcgtcttcgggaactgcgaacctaaaggttccaccgttcccgtgggtccacggccccaagggccccaaaccccaactcgtccaccttccttccgttaaccccc

SEQ ID NO: 434523 - DNA, 520 bp, Homo sapiens
  misc_feature: GZ8MTXP01BCMG5.51.81.H04.1.454.CMB.2.raw
  modified_base (235)..(235): a, c, t, g, unknown or other
  modified_base (485)..(485): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggcaggccctgtgttggtgatgtataaagacactgagaggcctgagggatccgtgagcgattctccgtggctccgaggtcgaacgggacaacggtcacagttggacctatcgaagtgagtccaggcaggaggacgaggctgactattattagtacaaagtcaaacagaacaccattcggtattaagtgtcttcggaacttgcgacaaggtcacgtctgggttcncggcccaaggcccaaccgctacgctccttcgtccg

SEQ ID NO: 434524 - DNA, 620 bp, Homo sapiens
  misc_feature: GZ8MTXP01DUHQC.51.81.H04.1.454.CMB.2.raw
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgcttatggtaccagcagaacgccggccacggccctgtgttggtgatgtataaagacactgagacgccctgagggctccgtgagcgtacttctgtcgctcgaaggtcgaagggacaacggtcacgtagttcgggacctatacgaggttggacgtaccgaggcaagggaggacggacggactgattattagttggtaacaataccaaacgagaacctaacctagtttacggttactttagtcgtttaccgttcgggtaaacttcggaccgtaaaccgaacgggttcccgtaacccggtttccgttcggggttaccgaacccggtaccccgaaaccggttacccccaaaccccttacggttaaccgttcccgttaaccccg

SEQ ID NO: 434525 - DNA, 623 bp, Homo sapiens
  misc_feature: GZ8MTXP01ELWNB.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtacagcagaagccggcaggcccctgtgtggtgatgtaataaagacactgagaggccctgagggactccctgacgcgattctccgtggctccgaggtcgaagggacaacggtcacattcggccatcagtggatccgaggcagaggacgaggtctagacttagttattagtaccaaagttacaaacgtaacgaacctaacccgtaagttacggttaactttaattcggttaccgttaccgggtaacttcggaaccgtaaacccgaaagggttacccgaaacccggttcccgtacgggggttacccaaccggacccccgtaaacggggacccccaaaacccccggaccttcggttaccctaacccgttcctttcccccg

SEQ ID NO: 434526 - DNA, 606 bp, Homo sapiens
  misc_feature: GZ8MTXP01APLEH.51.81.H04.1.454.CMB.2.raw
  modified_base (237)..(237): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgcttattggtaccagcagaagccggccacggccctgtgttggtgatgtaataaagacacgtgaggacggccctcgagggactccgtgacgcgtattctccgtggctcgaggtcgaaagggaccaacgggtacacgagttcggaccatcgagtcggacgtccgagggcaagggaggaccggaggctcgaacgttattagtgtacaacgtacaaacacgtaaccaccgtagtttacggtacctttaagttcgttacgttacggaacgttcgaaccgtacgttaaacggtccgaaccgtccgtagggttcccgacgttccccgaacggtacccaacccctcgtcgttacctaaccttcgtttaaccccg

SEQ ID NO: 434527 - DNA, 545 bp, Homo sapiens
  misc_feature: GZ8MTXP01EQSTA.51.81.H04.1.454.CMB.2.raw
  modified_base (234)..(234): a, c, t, g, unknown or other
  modified_base (277)..(277): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggccctgtgttggngatgtataaagacactgagacggccctgaacgggactcccgtgacgcgattctcctggctcgaggtcgaagggacaacggtcaacgtattcgggacctatcgaggtggagtccgaggcaggaggacgaggctgacttatatgacaatacaacagacactagttgtacttatgtcttacggaactgaaccgtacgaacggtcaccggtcgtgggttcacgacccgaacggccccaaccccgtactcgttacctaaccgttctttccccg

SEQ ID NO: 434528 - DNA, 530 bp, Homo sapiens
  misc_feature: GZ8MTXP01CENJI.51.81.H04.1.454.CMB.2.raw
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggcaggcccctgtgttggtgatgtaataaagacactgagaggcccctgagggatcccgtgagcgattctcctggctcgaggtcgaagggacaacggtcacgattggccatcagtggagtccgaggcagaggacgagctgactatatgtcaatcaacagacaccattggtacttatgtcgttcggaacttggcgaaccgttaaggtcaacccgttcgtgggttcgcgccccaagggccccaaccccgctcgcctaacgttcttccccg

SEQ ID NO: 434529 - DNA, 632 bp, Homo sapiens
  misc_feature: GZ8MTXP01BU7M2.51.81.H04.1.454.CMB.2.raw
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggcaggccctgtgtggtgatgtataaagacactgagaggccctgagggactccctgagcgattctccgtggctccgaggtccgaagggacaaccgggtcaacgagttcgggcctaatcgaaggttggaagtcccgaagggccaagggaacgggacggaagggtctaggaacttattaagttgtacaaagttcaaactagaacctaaccgtatttacgggtaactttaagtcgttacgtttaccgggaaacttcggaaccgtaaaccgaaacgggttcccgttaacccggttccggtggggttacccgaccggaccccgtaaacgggccccaaaccccaccgttcgttaccctaaccgttccctttccccg

SEQ ID NO: 434530 - DNA, 510 bp, Homo sapiens
  misc_feature: GZ8MTXP01A1UHO.51.81.H04.1.454.CMB.2.raw
  modified_base (235)..(235): a, c, t, g, unknown or other
  modified_base (361)..(361): a, c, t, g, unknown or other
  modified_base (396)..(396): a, c, t, g, unknown or other
  modified_base (495)..(495): a, c, t, g, unknown or other
  modified_base (499)..(499): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccccgtgacgcgattctctggctccaggtcaagggacaacggtcanattggccatcagtgagtccaggcagaggacgaggntgacttatatgtcaagtcaacagacaccattggtacttatgtcttcggactgcgacgttaaggtcacgtccgtaggttcacgcccaaggcccaaccccnctcnctcttcgtccg

SEQ ID NO: 434531 - DNA, 639 bp, Homo sapiens
  misc_feature: GZ8MTXP01DSW9A.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggataacctgctctggagatgcattgaccaaacgatatgcttattgacagcagagccggcaggccctgtgtggtgatgtaataaagacactgagacgccctcgaggactcccgtgagcgtattctctcggcctcgaggtccgaagggaaaccaacggtcaacgtagtttcgggacctaagtacgagggttacgggacgtacccgaagggacgaggaagggacggaggctaggtacttaattattgtaacaaatacaaacaggaacctaacctagtttacggtactttagttacgttcgttacggtaactcggaccgtaaaccgtaaacggttccgtaaaccccggttcggttacggggttaaccaaccggacccgaaaaccggaaccccaaaacccccgtaacgttacgtaccttacctttccgttcccgtttcccccc

SEQ ID NO: 434532 - DNA, 543 bp, Homo sapiens
  misc_feature: GZ8MTXP01EXGCA.51.81.H04.1.454.CMB.2.raw
  modified_base (240)..(240): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgcttatggacagcagaacgccggcacgccctgtgtgtgatgtaataaagcactagagacggccctacgagggactcccgtgacgcgtacttctcgtggcctcgaaggtcgaagggacaacgggtcactagttcggaccatcgagtggacgtccaggcgaagaggtacgaggctagaatattagttgataatacaacagacactagttacgtacttagtcgtacttcggaacttcgacgaaccgaagtccgaccgttcgttcgggacaacgcccgaacggacccacccgatcgttctaacc

SEQ ID NO: 434533 - DNA, 646 bp, Homo sapiens
  misc_feature: GZ8MTXP01BQHDG.51.81.H04.1.454.CMB.2.raw
  modified_base (223)..(223): a, c, t, g, unknown or other
  modified_base (240)..(240): a, c, t, g, unknown or other
  modified_base (280)..(280): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgaccaaacgntatgcttatggacagcagagccggcaggccctgtgtggtnatagtaataagacacgtagagacggccctagacgggacttcccgtagacgtcgtacttccgtcgtcggtccctaccgaacgggtacgaacggggaacctaaacgggtcacgtagttcggacctatacgaggtggacgtcgaggacgaaggacgggaacgaggctagtaacttattagttaggtaactaaataccaaacgaacgaacctaccgtaagtttacggttaacttacgttacgttccgttacggaaacttcggacccgtaaaccgttaacgggttacccgtacccggttccggttcgggacccgaaccggaccccgaaaccggaccccaaaccccggttacttccggttaaccctaacccg

SEQ ID NO: 434534 - DNA, 638 bp, Homo sapiens
  misc_feature: GZ8MTXP01DBRCA.51.81.H04.1.454.CMB.2.raw
  modified_base (320)..(320): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaacgatatgcttatgtacagcagacgccggcagccctgtgtggtgatagtataagcactgagacggccctcgagggacttcccngacgcgtacttcctcgtggcctaccgaagggtacgaagggacaacgggtcactacgttcggacctatccgtaggttagggacgtccgaggcgaagggagggaacggaggcgtacgtaacttaagtttactttcggggtaactaaacttaccaaacaacgaaccctaaccgtatttacgggttaacctttagttaggttccgttaacgggaactttcggaccgaaacccggttaacggtcccgtaacccgttcggttccggggttacaacccggacccgaaccgggtaccccaaccccgacttccgttccgttaacccg

SEQ ID NO: 434535 - DNA, 538 bp, Homo sapiens
  misc_feature: GZ8MTXP01EJ18C.51.81.H04.1.454.CMB.2.raw
  modified_base (236)..(236): a, c, t, g, unknown or other
  modified_base (498)..(498): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttatggtaccagcagaagccggcaggccctgtgtggtgatgtaataaagacactgagaggccctgagggactcccgtgacgcgtattctcgtcggctccgaggtcgaaacgggacaacgggtcaactagttcggaccaagtcgaggtggacgtccgaggcgaggagggacgaggctagacttatattagacaagtacaacagacactagttgtattagtgtctcgactgaacgacgaaggtccacgtcgtgggttcncgacccaaggacccaacccactcgacctaaccttcgtccc

SEQ ID NO: 434536 - DNA, 508 bp, Homo sapiens
  misc_feature: GZ8MTXP01A58MJ.51.81.H04.1.454.CMB.2.raw
  modified_base (238)..(238): a, c, t, g, unknown or other
  modified_base (282)..(282): a, c, t, g, unknown or other
  modified_base (473)..(473): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagcggccaggcccctgtgttggngatgtataaagacactgagaggccctcgagggatccctgagcgattctctgctccaagggtcaagggacaaacgggtcacgattggccatcagtggagtccgaggcaggaggacgaggctgactattaatgggtacaatcaacagacacattgtacttatgtcttcggaactgcgacaagtccacgttcgnggttcaagcccaaggcccacccgactcgttcaacc

SEQ ID NO: 434537 - DNA, 612 bp, Homo sapiens
  misc_feature: GZ8MTXP01AD4CC.51.81.H04.1.454.CMB.2.raw
  modified_base (221)..(221): a, c, t, g, unknown or other
  modified_base (239)..(239): a, c, t, g, unknown or other
  modified_base (291)..(291): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaacgntatgtcttattggtaccagcagaagccggcaggccctgtgttgtgatgtaanaagacactgagaggccctcgagggactcccgtagacgcgtacttctcgtcggtctcccgaagggttccgaagggacgaaaccgggtcactagttcggccagtcaaggtggacgtccgaggccgaaggacggacgagggtctagtaacttagtttagttcgggttacaaacttccaaaacgagtaacctaaccgtagtttaggttaactttacgtgttaccgttacggaacgtcgttaccgaaccgaacgggttcctacccgttcggttcggttaccaacggacccaacggaccccaaccccgacgttcgcccgttaacccg

SEQ ID NO: 434538 - DNA, 700 bp, Homo sapiens
  misc_feature: GZ8MTXP01A35IE.51.81.H04.1.454.CMB.2.raw
  modified_base (238)..(238): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtggagatgctattcgaccaaacgntatgtactttagttcggtacagcagaacggccggccacggccctgtcggttggtgtatagtaataaagacagtggaacgacggtcctacggacgggtactcccgtagacgcgttacttcgtccgtcggtctaccggtaggtacgaaacgggtaaccgaacggtacaacgtagttcggacctagtcgtaggtacggacgtaccggagggacgaagggaacgggaacggacggtcgttaacggtaactttaacgtttacgttacgtaaccaaacgttacgaaaccgtacgaacccgtaacttacggttagttaacgtttagttcgttaccgttacggaaccttggaacccgtaacgttacggtcccgaccggttccggtcgggttacccgaacggttaccccgaaacccgggtacccctaaaccccgtcgtacggttaccctaaccgtttcccgtttaaccccg

SEQ ID NO: 434539 - DNA, 530 bp, Homo sapiens
  misc_feature: GZ8MTXP01DIY8S.51.81.H04.1.454.CMB.2.raw
  modified_base (236)..(236): a, c, t, g, unknown or other
  modified_base (279)..(279): a, c, t, g, unknown or other
  modified_base (415)..(415): a, c, t, g, unknown or other
  modified_base (484)..(484): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaacgntatgcttatggtaccagcagaagccggcaggccctgtgttggngatgtaataaagacactgagagccctgagggatcccgtgagcgattctcctggctcgagtcaagggacaaggtcacagttgccatcgagtggagtccgagcgagaggacgagctgacttagtattgacaatcaaanagacactagttgtacttatcgtactcggtaactgcgaaccgttaggtccttaccggtcgtcgggttacncgacccaacggacccaacccgcttcgacctaacgttcgttaacccg

SEQ ID NO: 434540 - DNA, 693 bp, Homo sapiens
  misc_feature: GZ8MTXP01EQJY9.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagatgcattgaccaaaccgatatgtcttatggtaccagcagaacgccgggccacggccctgtgttggtgatgtaataaagacacgtgagacggccctcgagggactcccgtgacgcgtattctccgtggctcgacggtcgaaacggggaccaacgggtcaacgtagttcggaccctaagtccgaagggtcggacgtacccggagggacgaaggaagggaccggagggtaccgtaggtaacttaatttagtttacgtaacaaacgttacaaacgtaacgaaccctaacctaagtttacgggtttaacctttaagttcggttccgtttaacggaaccgttcggaacccggtaaccgttaaacgggttcccttaaacccggttccggtcggggttacccgaaccggaccccgaaaaccgggcccccctaaaacccccgttaacgtcccggttaccgtaacccgttcccttttcccccg

SEQ ID NO: 434541 - DNA, 493 bp, Homo sapiens
  misc_feature: GZ8MTXP01BK2SD.51.81.H04.1.454.CMB.2.raw
  modified_base (232)..(232): a, c, t, g, unknown or other
  modified_base (305)..(305): a, c, t, g, unknown or other
  modified_base (405)..(405): a, c, t, g, unknown or other
  modified_base (415)..(415): a, c, t, g, unknown or other
  modified_base (488)..(488): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggccaggcccctgtgttggtgatgcataaagacactgagaggccctnagggactccctgacgcgattcctctggctccgaggtcagggaacaacgggtcacattggccatcagtggagtccgaggcagaggacgaggctgactattntgcaatcaanagacaccatggtacttatgtcttacggactgcgacaaggccacgcttgggcacgccagccaacccgcttgtcnctccg

SEQ ID NO: 434542 - DNA, 600 bp, Homo sapiens
  misc_feature: GZ8MTXP01BAEBZ.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgatatgcttatggtacagcagagccggcaggccctgtgttggtgatgtataaagacactgagacggccctcgagggactccgtgacgcgtattctccgtggctccgaggtcgaagggacaacggtcacgattcggccatcgagtggagtccgaggcgaggaggaccgaggctgaacttattattgtacaactacaaacgacgaactaccgtagtttacggttaacttagttcgttaccgtttacggtaaccgtcggaaccgtaaaccgttaacgggttccaacccggttccggtgggttacccgttacggaccccgaaagggaccccctaaaccccgacgtcgttacctaaccttccgtttaaccccg

SEQ ID NO: 434543 - DNA, 592 bp, Homo sapiens
  misc_feature: GZ8MTXP01DZLVD.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgtcttatggtaccagcagaacgccggcacggcccctgtgttggtgatagtaaataaaggacactgaacgacggccctcggaagggtactcccgtgacgtcgacttctcgtcggctcgaggtcgaaagggactaacgggcactagttcggcccagtcgaggttggacgtccgagggcaggaggaacgaggtctgaacttattagttagtacaagtacaacagaccactagttgtacttagtcgttcgtacgaactggaaccgtaacgaacggtccttaaccggttccgtcgggttacgaccgaccccgaagggaccccaaacccgtctcgttacctaacttccgttaaccccg

SEQ ID NO: 434544 - DNA, 605 bp, Homo sapiens
  misc_feature: GZ8MTXP01CA1P9.51.81.H04.1.454.CMB.2.raw
  modified_base (218)..(218): a, c, t, g, unknown or other
  modified_base (549)..(549): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaaccgatatgtcttattggtaccagcagaagccggcaggcccctgtgtggtgatgtaataaagacactgagacggccctgagggactccctgagcgattctcctggctcgaggtcaaagggacaacggtcaactagttgggacccagtcaaggtgggagtcccgagggcgaaggagggacggaaggccgtaggaaccttagttagttgtactaaagtacaaacgacgaactacctagtttggtaactttaagtgttaccgttacggaaacttggaaccgtaaccgttaaggtcccgttaccgtaccgtggggttaccncggttaccccgaaacggccccaaacccctcgtcgttacctaacgttccgttccccg

SEQ ID NO: 434545 - DNA, 662 bp, Homo sapiens
  misc_feature: GZ8MTXP01AMQRY.51.81.H04.1.454.CMB.2.raw
  modified_base (218)..(218): a, c, t, g, unknown or other
  modified_base (235)..(235): a, c, t, g, unknown or other
  modified_base (278)..(278): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatggtaccagcagaagccggcaggccctgtgttggngatgtaataaagacactgagacggccctgagggactcccgtgaacgcgtattcgtccgtcggctccgaggtacgaagggacaacggtcaaccgagttcggacctagtcgagtggacgtccgaagggcaagggacgggaccggaggtaccgtggaacctttaagttacgttacgttaacaaacgttacaaaacgacggaaacctaacccgtaagtttacgggtaaacctttaagttcgttaccgtttaacggaaccgttggaacccgtaaacccgttaaagggtcccgttaaacccggttccggtacggggttaccaaccggccccgaaacgggaccccaaccccgtaacgttccggttacctaaccgttcccgtttcccccggg

SEQ ID NO: 434546 - DNA, 532 bp, Homo sapiens
  misc_feature: GZ8MTXP01AKF3P.51.81.H04.1.454.CMB.2.raw
  modified_base (234)..(234): a, c, t, g, unknown or other
  modified_base (486)..(486): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggccaggcccctgtgttggtgatgtaataaagacactgagacggccctgagggatccctgacgcgattctcctggctcgaggtcaagggacaacggtcacagttcggccatcagtggagtccgaggcagaggacgaggctgacttattattgacaagtcaaacagaacacctagttggtacttatgtcttacggactgccgacaagggtccaccggtccgtgggcncgaccccgaaggccccaaccccatcgttcctaaccttcgttccccg

SEQ ID NO: 434547 - DNA, 577 bp, Homo sapiens
  misc_feature: GZ8MTXP01BK0TR.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggccctgtgtggtgatgtaataaagacactggagacggccctgagggactcccgtgacgcgtattcgtcctggctccgaggtcaaagggaacaacggtcactagttcggaccatcgagtggacgtccaggcaaggaggacgaggctagactattattgtacaagtcaaagtacgactacctagttggtactttaagtcgttacgttcggaaactcggaaccgtaccaagggtcccaccggttccgtacgggttaccacggaccccgaacgggaccccaaacccctcgtacgttccctaaccttccgttccccg

SEQ ID NO: 434548 - DNA, 677 bp, Homo sapiens
  misc_feature: GZ8MTXP01DQSFM.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgtcttatggtaccagcagaagccggcacggccctgtgttggtgatgtaaataaagacactgagacgccctgagggactccgtgagcgattctccgtcggctccgaggtcgaaagggaacaacgggtcaacgtattcggaccctagtacaggtaggacgtccgaagggcgaagggaagggaacggtaggacgtacggaacttatttaagtttcgtaactaaacgttaacaaaacgaacgtaacccaaacctagtttacggttaacctttaagttcgttaccgtttaccgggaaaccttcggaaccgtaaacccgaaacggggttccccttaaacccggttcccggtacggggttacccgaacccggaaccccgaaaccgggaccccctaaacccccgtaacgtcggttacccttaacccgttttcccggtttcccccccg

SEQ ID NO: 434549 - DNA, 598 bp, Homo sapiens
  misc_feature: GZ8MTXP01ACFR4.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgcttattggtaccagcagaagccggcagccctgtgtggtgatgtataagacacgtgagacggccctcgagggactcccgtagagcgtacttctctggcctcgaaggtcgaagggacaacgggtcactattcggccatcgagtggacgtccgaggcaggacggacgagggctagtacttagttagttcggtactaatacaaacgacgaccaccgtatttacgggtaactttagttacgttccgttacggtaaacgttcggaccgaaccgttaacgggtacctaacccgggttccgttcggggttaccaaccggacccgaaaccggccccaaaccccttcgtcgttaaccgttccccg

SEQ ID NO: 434550 - DNA, 719 bp, Homo sapiens
  misc_feature: GZ8MTXP01EM8U2.51.81.H04.1.454.CMB.2.raw
  modified_base (221)..(221): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaagccgggccacggcccctgtgttggtgatgtaataaagacacgtgagacggccccttcgaggggactcccgtagacgcgtacttctcgtcggcctcccgaagggtcgaaggggtaaccaaacgggttccaacgtacgtttcggggaccctagtaccgaggttagggaacggttcccgaaggggaccgaagggaacggggaaccggaagggtccgttaggaacgtttaatttacgtttgggtactaaagttaccaaacgacgaaccctaaccttagtttacggtttaacttaacgttggttacccgttaccgggtaaaccgttcggacccggtaaacccgttaaacgggttccccgtaacccggttacccggttcgggggttacccaaccggtacccccgaaaaccggggtaccccccaaacccccggttaaccgtttccgttaacccgtttaaccccg

SEQ ID NO: 434551 - DNA, 633 bp, Homo sapiens
  misc_feature: GZ8MTXP01BLBLA.51.81.H04.1.454.CMB.2.raw
  modified_base (234)..(234): a, c, t, g, unknown or other
  modified_base (237)..(237): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntangcttatggtacagcagagccggcaggccctgtgttggtgatgtaataaagacactgagacggccctacgagggactcccgtgaagcgattctccgtgggctccgaggtcgaaacgggaactaacggtcaactagttcggacccaagtcgaaggtggacgttacccgagggcaggagggacggaaggcctagacttaatttattagtaccaagttaccaaacgaacgacctaaccgtaagtttcgggttaacctttagtcgttaccgttaccgggtaaacttcggaacccgtaacgttaaacggggtccaacccggttccgtggggttacccacggacccccgaaacgggccccaaaaccccgcttacggttaccctaaccgttcccgtttccccgg

SEQ ID NO: 434552 - DNA, 520 bp, Homo sapiens
  misc_feature: GZ8MTXP01CFWAE.51.81.H04.1.454.CMB.2.raw
  modified_base (82)..(82): a, c, t, g, unknown or other
  modified_base (232)..(232): a, c, t, g, unknown or other
  modified_base (273)..(273): a, c, t, g, unknown or other
  modified_base (380)..(380): a, c, t, g, unknown or other
  modified_base (476)..(476): a, c, t, g, unknown or other
  modified_base (496)..(496): a, c, t, g, unknown or other
tcagcgatcgtatacacgaccggtgctcgatttagtagtgtagattcgcggggtgggtccaggaggcagaactctgggtgtntcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggccctgtgtgngatgtataaagacactgagaggccctgagggatcctgagcgattctcctggctccgaggtcaagggaccaacggtcacattcggcatcagtgatcgagcagagacgnggctgactattatgtacaatcaacagaacacctattggtacttaatcgtcttacggaactggaacaaccgaagggttccaccggtctggggttccngacccgaaggccccaacccnctacgttctaacgttcttaacccg

SEQ ID NO: 434553 - DNA, 537 bp, Homo sapiens
  misc_feature: GZ8MTXP01EVPRG.51.81.H04.1.454.CMB.2.raw
  modified_base (233)..(233): a, c, t, g, unknown or other
  modified_base (425)..(425): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggtgatgtataaagacactgagaggccctgagggactcctgagcgattctcctggctcgaggtcgaagggacaacgggtcaacgattggccatcagtggagtccagggcaggaggacgagggctgacttattattgtacaagtcaaanagacaccattggtacttatgtcttcggaactgcgaacgaagggtccaaccgtccgtgggttccgacgccccgaagggcccaaaccccgctcgttccaaccgttcttaacccg

SEQ ID NO: 434554 - DNA, 560 bp, Homo sapiens
  misc_feature: GZ8MTXP01C27YH.51.81.H04.1.454.CMB.2.raw
  modified_base (234)..(234): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcacctgctctggagatgcattgaccaaacgntatgtcttatggtaccagcagagcggcaggccctgtgtggtgatgtaataaagacactgagacgccctgagggactccgtgagcgtattcctccgtggctcgaggtcgaaacgggacaacgggtcaactagttcggaccatcgagtcggagtccgaggcgaggaggacgaggctgacttatattgtacaagtacaaacaagaccaactagttacggttacttatgtacgtacggaaactgaacgaacgaaggtccaccgttacgtcgggttaccgacgacccgaacggacccaaccctacgtcgttcctaaccttcgttaaccccg

SEQ ID NO: 434555 - DNA, 580 bp, Homo sapiens
  misc_feature: GZ8MTXP01ANW6N.51.81.H04.1.454.CMB.2.raw
  modified_base (217)..(217): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgaccaaacgatatgcttatggtaccagcagaagccggcaggccctgtgttggtgatgtataaagacactgagaggcctgagggatcctgagcgattctctggctcgaggtcaagggacaacggtcacattggaccatcgagtggacgtaccgaggacaggaggacgaggctggaacttattattgtacaaagtcaaatacgacaacctagtttagggtacctttagtcgttcgtttaccggaaacttcggccgtaaaccgttaacgggtccgaacccggttccgttacggggttccgaaccggaccccaaacgggccccaaaccccgtacgtcgttccaaccgttccgtttccccg

SEQ ID NO: 434556 - DNA, 693 bp, Homo sapiens
  misc_feature: GZ8MTXP01D8NQT.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgacccaaacgatatgcttatggtaccagcagagccggcacggccctgtgtgtgatagtataaagcactgagacggccctgagggtactcccgtgacgcgtacttctcgtggctccgaagggtcaacggggacaacgggtcaccgtagttcgggacctatcgaaggttcggacgtccgagggaccgaagggaacgggaccggagggtacctaggtaacctttaatttaagttcgggttaacaaatttaaccaaacgaacgtaaccaacccgttagttttaacgggtttaactttaaacgttcggttaccctttaacgggtaaaccgttcgggaacccggtaaacccgttaaaagggttccccgtaaccccgggttaacggtttccggggttaccaacccggtaaccccccgtaaacggggtacccccaaacccccggttacgtttccgttccccgttaaccccg

SEQ ID NO: 434557 - DNA, 353 bp, Homo sapiens
  misc_feature: GZ8MTXP01A7JDS.51.81.H04.1.454.CMB.2.raw
  modified_base (237)..(237): a, c, t, g, unknown or other
  modified_base (337)..(337): a, c, t, g, unknown or other
  modified_base (344)..(353): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggcaggccctgtgttggtgatgtaataaagacactgagaggccctgagggatccctgagcgggctggcaaggcncaatagnnnnnnnnnn

SEQ ID NO: 434558 - DNA, 703 bp, Homo sapiens
  misc_feature: GZ8MTXP01ERJM7.51.81.H04.1.454.CMB.2.raw
  modified_base (234)..(234): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggccctgtgtggtgatgtataaagacactgagacggccctcgagggactccgtgagcgattcctccgtggctccgaggtccgaaaggggaccaacggttcaacgtagtttcgggacctatcgaaggttcgggaacgtcccgaagggaccaagggacgggtaacggacgggtacgtacggaactttagttatttacggtaccctaaaagttccaaaaaccggtaagaaacccgtaaccttaaacgttttaggggtttaaacccttttaagttgtttaccccgttttacgggaaaccgtttcggaacccggtaaaccgttaaacggggttcccgttaaacccgggttcccggttacgggggttacccttaaccgggacccccgaaacgggacccccgaaaccccctcgttacccggttaactccccgtttcgtttcccccgg

SEQ ID NO: 434559 - DNA, 544 bp, Homo sapiens
  misc_feature: GZ8MTXP01CNEGI.51.81.H04.1.454.CMB.2.raw
  modified_base (236)..(236): a, c, t, g, unknown or other
  modified_base (405)..(405): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttatggtaccagcagagccggcaggccctgtgtggtgatgtataaagacactgagaggccctagagggatcccgtgaacgcgattctcctggctccgaggtcaaagggacaacggtcacattggccatcgagtcgagtccaggcagaggacgaggctgatattntgacaatcaaacagaacaccattggtacttaatgtctttacggaacttgaacgaacgaaacggttcacccgtccgtgggttccacgggcccaaacgggcccaacccctactcggttacctaaccgttcgtttaaccccg

SEQ ID NO: 434560 - DNA, 586 bp, Homo sapiens
  misc_feature: GZ8MTXP01C9RAK.51.81.H04.1.454.CMB.2.raw
  modified_base (235)..(235): a, c, t, g, unknown or other
  modified_base (277)..(277): a, c, t, g, unknown or other
  modified_base (425)..(425): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcaggccctgtgtggngatgtataaagcactgagacggccctgagggactcccgtgagcgtattctccgtggctccgagtcgaagggacaacggtcaacgattcggccagtcaaggtgacgtccgaggcaggaggacgaggctagactatatgacaagtcaaanagaccactagttgtacttaatcgttcttacggaacttgaaccgtaaccgttaaagggtcccttaaaccggttccgtacgggggttacccaacggacccccgaaacgggacccccaaaccccgtacgttaccggttacctaacccttcccgttttcccccgg

SEQ ID NO: 434561 - DNA, 561 bp, Homo sapiens
  misc_feature: GZ8MTXP01A09T1.51.81.H04.1.454.CMB.2.raw
  modified_base (238)..(238): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtacagcagaagccggcagccctgtgtgtgatgtataagacactgagacggccctgagggactcccgtgacgcgtacttcgtcgtggctccgaaggtcgaagggacaacgggtcacgtagttcggaccatcgaagtggacgtccgaggacaggaggacgaggctgactagttacttggactatacaacgacgacactagttggtaacttagtcgtcgtttacggaacttcggaccgtaaccagggtcccaaccgttccgttcggggaccaacggaccccgaacggccccaaacccgcgttcgttcctaacccg

SEQ ID NO: 434562 - DNA, 602 bp, Homo sapiens
  misc_feature: GZ8MTXP01CS2CJ.51.81.H04.1.454.CMB.2.raw
  modified_base (177)..(177): a, c, t, g, unknown or other
  modified_base (336)..(336): a, c, t, g, unknown or other
  modified_base (349)..(349): a, c, t, g, unknown or other
  modified_base (406)..(406): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctctatgagctgacacagccaccctcggtntcagtcgtcccaggacagacggcaggatcactgctctggagatgctattcgaccaaacgatatgtacttagttcggaccagacgagaacggccgggccacggccctgtggttggtagatagtaataaaggacatagagacggccctagagggattcccngacggcacttctncggctacccgaagggttcgaagggacaaacgggtcaacagttcggaccatcaagggnggacgcgaggacgaaggacggacggtagctagtaacttaagttacgtacgtaactaaactacaaacgtaacgaacctaacgtagttacgtacttagtcgttactacggaactcgaccgtaaacgacggtaccgtaccggttaccgcgggaccgaacgaaccccgaacggacccaacccttacgttcgaacctaacg

SEQ ID NO: 434563 - DNA, 619 bp, Homo sapiens
  misc_feature: GZ8MTXP01BS1WX.51.81.H04.1.454.CMB.2.raw
  modified_base (235)..(235): a, c, t, g, unknown or other
  modified_base (308)..(308): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccgggcaggccctgtgttggtgatgtaataaagacactgagacggccctnagggactcccgtgagcgtattctccgtggctccgaggtcaacgggacaacggtcacgagttcggcctatcgagtggacgtccgaggcaggacggtacgagggctaggaacttattattgtacaaacgtacaaacgtacgaactaccgtaagttcggttaacttaagtcgttaccgttaacgggtaaactggaacccggtaaaccttaaaggggtcccaaccggttcccgtttacgggggaccacgggacccccgaaacgggacccctaaaccccctacgttcgttaccgtaaccctttcccgtttccccgg

SEQ ID NO: 434564 - DNA, 606 bp, Homo sapiens
  misc_feature: GZ8MTXP01CU62Y.51.81.H04.1.454.CMB.2.raw
  modified_base (238)..(238): a, c, t, g, unknown or other
  modified_base (480)..(480): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgctattcgaccaaaacgtntatgtactttagtggtaccagcagaacgccggcacggccctgtgttggagtatgtaaataaagacacgtagagacgccctagagggactccgtagagcgtattctccgtggctccgaggtacgaaacggggaacctaacgggtactaacgtagtttccgggacctagttcgaaagggtcggacgtccgaaggcgaaggacggtaacggagtctaagtacttattatgtacaagtacaaaganaacacttagttagtattatcgttacttacggaatcggaaccgtaacgagtccgaccgttccgtgggttaccacgacccgaaggaccccaacccgtcgtacttaccctaacgttccgtttaaccccg

SEQ ID NO: 434565 - DNA, 539 bp, Homo sapiens
  misc_feature: GZ8MTXP01DQEX4.51.81.H04.1.454.CMB.2.raw
  modified_base (235)..(235): a, c, t, g, unknown or other
  modified_base (278)..(278): a, c, t, g, unknown or other
  modified_base (430)..(430): a, c, t, g, unknown or other
  modified_base (454)..(454): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatgtaccagcagaagccggcacgccctgtgttggtnatgtaataaagacactgagacggcccctacgagggactcccgtagagcgattcctcgtcggctccgaggtcaaagggacaacggtcacattcggaccagtcagtggacgtcgaggcagaggacgagctgactattattgtaccaagtacaanaagaccactagttgttacttagtntcgttacgactgcaacgaggtccttaccgtcgtggttccgcgacccgaacggacccaacccactcgttcctaacttccgttcccg

SEQ ID NO: 434566 - DNA, 609 bp, Homo sapiens
  misc_feature: GZ8MTXP01BJ9SR.51.81.H04.1.454.CMB.2.raw
  modified_base (235)..(235): a, c, t, g, unknown or other
  modified_base (279)..(279): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagagccggcacggccctgtgttggtnatgtaataaagcactgagacggccctagagggactcccgtgacgcgtattcctccgtcggcttccgaagggtccgaaaggggaacctaacgggtcaaccgtagtttcgggaccctagttcgaaggttggacgtccgagggcaagggaggaacggaggcgtagaacttagttattgtacaagtacaaacaagacctaaccgtagttcggttaacttagtcgttaccttacgggaactggaacgtaaccgttaagggtccttaccggtccgtggggttaccacggcccaaacggccccaacccctactcgttacctaactttccgttccccg

SEQ ID NO: 434567 - DNA, 725 bp, Homo sapiens
  misc_feature: GZ8MTXP01CJFGM.51.81.H04.1.454.CMB.2.raw
  modified_base (237)..(237): a, c, t, g, unknown or other
  modified_base (253)..(253): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacancagaagccggcagccctgtgtgtgatgtaataaagcactgagacggccctgagggtactccctgacgcgtaacttcgtctggcctcccgaaagggttacgaagggggaaaccaaaccggggttacaaccgtagtttcgggaccctaaagttccgaaggttgggaacgtacccgaaggacgaaggaacgggaacgaaggtccgtaaggtaaccttaaatttaacgttgggtaactaaaacgttaccgaaaacctaaacggaacccgtaaccctaagttttaacgggttaaacctttaaagttcggttaccgttttaacggggaaaaccccttgggttaacccggaaaccccgttaaaggggttcccctaacccgggttaccccgttgggggttaccccaaccgggtaacccccgaaacccggggtacccccaaaaacccccccgttacgttaacccgttaacccgttaacccg

SEQ ID NO: 434568 - DNA, 572 bp, Homo sapiens
  misc_feature: GZ8MTXP01DWBAU.51.81.H04.1.454.CMB.2.raw
  modified_base (238)..(238): a, c, t, g, unknown or other
  modified_base (276)..(276): a, c, t, g, unknown or other
  modified_base (313)..(313): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggacagcagaagccggcagccctgtgtgngatgtaataaagcactgagacgccctgagggatccgngagcgtattatctggctcgaaggtcaagggacaacggtcacgtagttcggacctatcgagtggacgtccgaggcgaaggaggacgaggactagaacttagttattgggtacaatacaaacagaacactaagttacggtacttagtcgttcgttcggaaactcgttccgaaacgttaacgggtacctaaccggttcgttcggggttaccaacggacccgaaacggccccaaccccgttacgttccgttaaccgtaacccg

SEQ ID NO: 434569 - DNA, 612 bp, Homo sapiens
  misc_feature: GZ8MTXP01B8QII.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgtcttatgtaccagcagagccggcaggccctgtgtgtgatgataaagacatgagagccctgagggactcctgagcgtattctccgtggctcgaggtcgaaagggaccaacggtcaactagttcggacctagtcgaagtggacgtccgagggacaggagggacggaggtctagtacttattagttagtacaagttacaaacgacgtaacctaacctagtttacggttaactttagtcgtttcgttacggtaactcggtaaccgaaaccgttacggtccgttaacccggtccgtttacgggacccaccggaccccgaaaccggacccctaaccccgaacgttcgttacccgtaacctttccccgtttaaccccgg

SEQ ID NO: 434570 - DNA, 751 bp, Homo sapiens
  misc_feature: GZ8MTXP01DL3Y2.51.81.H04.1.454.CMB.2.raw
  modified_base (239)..(239): a, c, t, g, unknown or other
  modified_base (257)..(257): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacacgccaccctcggtgtcagtcgtccccaggacagacggccaggatcacctgctcgtggagatgcattgaccaaaccgntatgcttatggtaccagnagaagccgggcaggcccctgtgttggtgatgtaataaagacacgtgagaacggtccctcgacgggactcccgtgacgcgtattctcgtcggtctccgacggttcgaaaggggaacctaacgggtcaacgtagtttcgggacccaagtcgtaggttacgggacgtaccgaggggacaagggaagggaaacggaacgggtccgtagggtaccttaaaggtttagttagtacctaaacgttaaccgaaacgtaaacgaaccctaaacctaagtttacgggtttaaacctttaagttacgttaccgtttacggggtaaacctttacggaacccgtaaaaccggaacggggttttacccgaaccccggtttacccggtttacgggggaaccccttaccggttaaacccccggtaaaaccgggggtaaccccccgaaaacccccgttaaacctccgggtttaacccctaaacccgtttcccctttttaaacccccccggg

SEQ ID NO: 434571 - DNA, 566 bp, Homo sapiens
  misc_feature: GZ8MTXP01EWPUY.51.81.H04.1.454.CMB.2.raw
  modified_base (222)..(222): a, c, t, g, unknown or other
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttatggtacagcagagccggcagccctgtgtggtgatgtaataagacactagaggacggccctagagggacttcccgtgagcgtatttcgtcgtggcctaccgaagggtcaaggggactaacgggtcactagttcggcctagtcgagtggacgtccgaggcgaaggaggacggaggctagaacttattattcgggtacaaagtacaaacgagaccactagttaggtaccttagtcgttcgttaggaaacttgaccgaacttagggtccaaccgttcgttgggccaacgcccgaacggccccacccactcgttaacgtaaccc

SEQ ID NO: 434572 - DNA, 561 bp, Homo sapiens
  misc_feature: GZ8MTXP01AY98E.51.81.H04.1.454.CMB.2.raw
  modified_base (423)..(423): a, c, t, g, unknown or other
  modified_base (502)..(502): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcagaagccggcacggccctgtgtggtgatgtataaagacactgagacggccctgagggactcccgtgacgcgtattctcgtggctccgaggtcaagggacaacggtcacattggccatcgagtgacgtccgaggcagaggacgaggctagactatatgtacaatcaaanagacacctagttcggtacttagtgttcgtacggtaactcgaacgaaccttaagggtccttacccgtcgttcggggaccnccggaaccccgaacgggccccaaacccctactcggttacctaacttcccgtttccccgg

SEQ ID NO: 434573 - DNA, 615 bp, Homo sapiens
  misc_feature: GZ8MTXP01AWOQ7.51.81.H04.1.454.CMB.2.raw
  modified_base (219)..(219): a, c, t, g, unknown or other
  modified_base (324)..(324): a, c, t, g, unknown or other
  modified_base (410)..(410): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgctattcgaccaaacgtatatgtacttattggtaccagcagaacgccggcacggccctgtgttggtgatgtaataaagacatgagacgcctgagggactccgngacgcgtattctccgtcggctccgaggtcgaaagggactaacggcactagttcggacagtcgaggtgatccgaggcaggaggacgnggctagtacttagttattgtacaagtacaaacgacgaacctaccgttaattacgggttactttagttcgttaccgttacggtacttcggaaccgtaacgttaacgggtccttaacccggttccgtacgggttaccgaccggaccccgaaaccgggacccctaaaccccgacgtaccggttacctaaccgttcccgtttcccccgg

SEQ ID NO: 434574 - DNA, 607 bp, Homo sapiens
  misc_feature: GZ8MTXP01B39P1.51.81.H04.1.454.CMB.2.raw
  modified_base (579)..(579): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattgaccaaaccgatatgtcttattggtaccagcagaacgccggccacggccctgtgttggtgatgtaataaagacatgagacggccctgagggactccgtgacgcgtatttcctccgtcgggctaccgacggtcgaaacgggaccgaacggtcaacgtagttcggcctagtcgaggtggacgtccgagggcgaggagggacgaggctagacttagttattgtacaagtcaaacagaacactagttggttaactttagtcgttaccgttacggaacttcggaaccgtaaaccgttacgggtcccgttaccgttccggtcgggttaccgaccgacccgaaccggaccccaaccccncttcgttacctaacttcccgttccccgg

SEQ ID NO: 434575 - DNA, 622 bp, Homo sapiens
  misc_feature: GZ8MTXP01EY57B.51.81.H04.1.454.CMB.2.raw
  modified_base (222)..(222): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgatatgcttatggtaccagcagaagccggcaggccctgtgtggtgatgtaataaagacacgtgagacggccctgacgggactccctgagcgtacttctcgtggcctccgaaggtcgaagggacaacgggtcacgtagttcggactagtcgagtggacgtcgaggacgaggaggacggaggctaggtaacttaagtttacgttaggggtactaaactaccaaacgtaacgaaccctaaccgttaagtttacgggttaactttacgttcgttaccgttacggaacgttcggaccgtaaaccgttaacgggtcctaacccggttccgttcgggaccaaccgaccccgtaaccgggccccaaccccgttattaaccggttcctaacccg

SEQ ID NO: 434576 - DNA, 506 bp, Homo sapiens
  misc_feature: GZ8MTXP01EK3PK.51.81.H04.1.454.CMB.2.raw
  modified_base (281)..(281): a, c, t, g, unknown or other
  modified_base (298)..(298): a, c, t, g, unknown or other
  modified_base (484)..(484): a, c, t, g, unknown or other
  modified_base (497)..(497): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggcaggccctgtgtggnatgtataaagcatgagnggccctgagggatcccgtgagcgtattctgtggctccgaaggtcaagggacaacgggtcactagttcggaccagtcaggtggagtccgaggcaaggacggacgaggctagacttattagttggtacaatacaacagacactattggtactatgtcttgaactgacacagtcacgttcgttgcaacnccaacgccacccntcgctaacc

SEQ ID NO: 434577 - DNA, 646 bp, Homo sapiens
  misc_feature: GZ8MTXP01B7S0G.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtctttagttggtaccagcagaacggccgggcacggccctgtgttggtgatagtaataaagcactgagacgcctgagggactccgtgacgcgtattcgtccgtcggctcgaggtcgaaacggggacaaccgggtcaacgtagttcggaccctatcgaaggtcgggagtacccggagggacgaagggacggggaacggaggggtccttagggtaaacctttaagtttagttagtaacctaaacttaccgaaacgacgtaacctaaccgttagtttacggtaacttttacgttcgttacgttaccggaacgttgaaccgtaacgaacgggtccaccggttccgtcggggttacacggaccccgaacggaccccaacccgtactcgttacctaacgttccgttaaccccg

SEQ ID NO: 434578 - DNA, 626 bp, Homo sapiens
  misc_feature: GZ8MTXP01DYBEP.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctcgtggagatgcattgaccaaacgtatatgtcttattggtaccagcagagccggcacggccctgtgttggtgatgtaataaagcacgtgagacggccctgagggactcccgtgacgcgattcctcgtcggctccgaggtacgaacggggactaacggtcacgtagttcggaccagtcgagttggacgtccgaggcaggaggacggaggtctagtacttagttattcgtacaagttacaaacgacgtaacctaaccctaagtttacggttaacctttaagttcggttaccgtttacggaacgttcggaaccgtaaccgttaaacggtcccttaaccggtccgttcggggttacccaccggaccccgaaccggaccccaaccccgtacgtcgttacctaaccttccgtttccccg

SEQ ID NO: 434579 - DNA, 605 bp, Homo sapiens
  misc_feature: GZ8MTXP01BMRO8.51.81.H04.1.454.CMB.2.raw
  modified_base (205)..(205): a, c, t, g, unknown or other
  modified_base (220)..(220): a, c, t, g, unknown or other
  modified_base (237)..(237): a, c, t, g, unknown or other
  modified_base (279)..(279): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggntcacctgctctgganatgcattgaccaaacgntatgtcttatgtaccagcagagccggcaggccctgtgtggtnatgtaataaagcatgagacggccctgagggactccgtagacgcgtacttctacgtcggctccgaggtcaaagggaccaacggtcactagttcggcctatcgagtggacgtccgaggcgaaggaggaacgaggtcgtagtaacttatttaagttcgtaactaaatacgaaacagaacctaacctagttaggttaactttagtcgttcgttacgggaaccttgaaccggtaacgttaacgggtccttacccggtaccgttcggaccgaccgacccgaaccgggaccccaaccccgtaactccggacctaacccgttccgttaaccccg

SEQ ID NO: 434580 - DNA, 526 bp, Homo sapiens
  misc_feature: GZ8MTXP01C6CXY.51.81.H04.1.454.CMB.2.raw
  modified_base (234)..(234): a, c, t, g, unknown or other
  modified_base (483)..(483): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtaataaagacactgagaggccctcgagggatccctgagcgattctcctggctccaggtcaaagggacaacggtcacattcggccatcagtggagtccaggcagaggacgaggctagactattattgtcaatcaaacagacacctattggtacttatgtcttacggactgcgaccaaggtccaccgtccgtgggttccncgccccaaggcccaaccccgctcgttcctaaccgttcttcccg

SEQ ID NO: 434581 - DNA, 631 bp, Homo sapiens
  misc_feature: GZ8MTXP01DUA5H.51.81.H04.1.454.CMB.2.raw
  modified_base (285)..(285): a, c, t, g, unknown or other
  modified_base (294)..(294): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactccctgcacaggctctgaggcctcctatgagctgacacagcccaccctcggtgtcagtcgtccccaggacaggacggccaggactcacctgctctggagatgcattgacccaaacgatatgtcttagttgaccagcagaagccggccacggccctgtgttgngtatgtaanaaagacacgtgagacggccctacgagggactcccgtgagcgtattctcgtcggcctacgaggtacgaacgggaaacctacggtcactacgttcgggacctagtcgtagggtaggacgtccgaaggcgaaggacgggacggaggtctagtaacttaattagttcgtaacaaacttacaaactaacgaacctaaccgtaagtttcgttaacctttagtacgttacgttacggtaactcgaccgaaaccgtaacggttccacccgttcggtgggtacccacggaccccgaacggaaccccaaacccctcgtaccgcttaccgtccgtttaaccgttcccc

SEQ ID NO: 434582 - DNA, 563 bp, Homo sapiens
  misc_feature: GZ8MTXP01AYE3C.51.81.H04.1.454.CMB.2.raw
  modified_base (238)..(238): a, c, t, g, unknown or other
  modified_base (279)..(279): a, c, t, g, unknown or other
  modified_base (322)..(322): a, c, t, g, unknown or other
  modified_base (435)..(435): a, c, t, g, unknown or other
  modified_base (541)..(541): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgntatgcttatggtaccagcagagccggcaggccctgtgtggngatgtaataaagacacgtgagacggccctgagggacttcccgngagcgattctccgtggctccgaggtcgaagggacaacggtcaacagttcggacctagtcaaggtggaacgtccgagggacaggaggacggaggtctaggtacttattagttanacaacgtacaacacgactaactagttagtacttagtcgttcgttacggactcggaacgtaacgacggtccgaccgtcgtcggcacgacccgaaccgacccaacccnctcgttacctccgttccgtccg

SEQ ID NO: 434583 - DNA, 582 bp, Homo sapiens
  misc_feature: GZ8MTXP01EU55J.51.81.H04.1.454.CMB.2.raw
  modified_base (283)..(283): a, c, t, g, unknown or other
  modified_base (442)..(442): a, c, t, g, unknown or other
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattgaccaaacgatatgcttattggtaccagcagaagccggccaggccctgtgttggngatgtaataaagacactgagacggccctgagggactcccgtgagcgattctcctggctcgaggtcaaagggaacaacggtcaacagttcggacctaagtcaaggtggacgtccgagggcaggaggacgaggctgaactattattagcaaagtcaaaganaacaacctattaggtactttaagtcgttcttacgggaaaccttggaacctaaaccgaaagggttccaacccggttcgtcggggttcacgaccccgaaagggccccaaaacccctctcgttaccaaccgtttccgttcccg

SEQ ID NO: 434584 - DNA, 638 bp, Homo sapiens
  misc_feature: GZ8MTXP01B15T6.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaacgntatgcttatggtaccagcagaagccggcacggccctgtgttggtgatgtaataaagacacgtgagacggccctgagggactcccgtgacgcgtattctcgtggctccgaggtcgaagggacaacggtcactagttcggccagtcgaggtggacgtccgaggcgaaggagggacgaggctaggaacttagttattgtacaacgttacaaacgtagaacctaacctagtttggttaacctttagttcgttaccgtttacgggaaacgttcggaacccgtaaccgttaacgggttacccacccggttacccggtcggggttacccgaccgggacccccgtaaacgggacccccctaaaccccgtaccgttccggttaccctaacccgtttcccgtttccccccggg

SEQ ID NO: 434585 - DNA, 618 bp, Homo sapiens
  misc_feature: GZ8MTXP01DWTAN.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaacgatatgctttatggtaccagcagagcggcagccctgtgtggtgatgtaataaatacactgagacggcccctgacgggactccctgagcgattcctccgtggctccgaggtcgaaacggggacaacggtcacgtattcggccagtcgagttggacgtccgaggcaggaggacggaggctagacttattagttagtacctaagttacaaacaacgaacctaaccgtagtttggttaactttacgttcgttaccgttacggtaaacgttcgaacgtaacccgaaacgggttcccttaaccggttcccgttcggggttaccaccggttaaccccgaacgggaccccaaccccgtacgtcggttacctaacccttccgtttcccccg

SEQ ID NO: 434586 - DNA, 637 bp, Homo sapiens
  misc_feature: GZ8MTXP01EMG8J.51.81.H04.1.454.CMB.2.raw
  modified_base (239)..(239): a, c, t, g, unknown or other
  modified_base (278)..(278): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgcttatggtacagcagacgccggcagccctgtgtgngatgtaataagctatgagacggccctgaggactcccgtgacgcgtacttcgtcgtcggtcctcccgaaagggtaccgaaggggaacctaaacgggtccaacgtagttcgggacctaagttcgaggttcgggacgtccgaagggacgaaagggacgggaacggagggtactacgtaacttaagttacgttagtaactaaactaccaaacacgaacctaacgttagtttacggttaactttagtacgttaccgttacggaaacttcgaccgtaacgttaacggtccgtaacccgttcggttcgggttaccaaccggacccgaaaccggccccaaaccccgttctccggttaacctaacccg

SEQ ID NO: 434587 - DNA, 619 bp, Homo sapiens
  misc_feature: GZ8MTXP01BHX2E.51.81.H04.1.454.CMB.2.raw
  modified_base (235)..(235): a, c, t, g, unknown or other
  modified_base (274)..(274): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagagccggcaggccctgtgtggngatgtaataagacactgagagccctcgagggactccgtgagcgtattctcgtggctccgaggtcaagggacaacggtcacgtagttcggacctatcgaggtggacgtccgaggcgagagggacgaggtctaggacttagttattagtacaaagtacaaacgacgtaacctaaccgtagtttacggttaacctttaagtcgttaccgtttacggaaaccgttcggaaccgtaaccgttaaacgggttcccgttaaccggttcccgtacgggggttacccaacggaccccgaaacgggtaccccaaaccccgtaacgtcggttaccctaacccgtttccttccccgg

SEQ ID NO: 434588 - DNA, 521 bp, Homo sapiens
  misc_feature: GZ8MTXP01DMLPJ.51.81.H04.1.454.CMB.2.raw
  modified_base (310)..(310): a, c, t, g, unknown or other
  modified_base (414)..(414): a, c, t, g, unknown or other
  modified_base (472)..(472): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctnagggactccgtgagcgattctctggctccgaggtcaagggacaacggtcacattggccatcgagtgagtccaggcagagacgagctgactatatgtcaatcaanagacacctattgtacttatgtctcggaactgcgacaggtccaccgtaccgtgggttcncggaccccaagggaccccaacccactcgacctaaccgttcttaaccccg

SEQ ID NO: 434589 - DNA, 599 bp, Homo sapiens
  misc_feature: GZ8MTXP01A3TQY.51.81.H04.1.454.CMB.2.raw
  modified_base (236)..(236): a, c, t, g, unknown or other
  modified_base (461)..(461): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgntatgtctttattggtaccagcaagaacgccggccaggcccctgtcgttggtgatgtaataaagacacgtgagaggccctgagggctccgtgagcgtattcctcgtaggtctccgtaggtccgaaaggggacctaacgggtcaactaagttcgggaccagttcgaggtaggtacgtccgagggcgaggaaggacggcggactaggtactagttattgtacaagtanaaacagacaactagttggtacttagtcgttacttaccggagtcgaacgaaccgttaacggtcaccggttcgtacgggttcaccggttaccccaagggacccccaacccgtactcgttacctaaccttcgttaaccccg

SEQ ID NO: 434590 - DNA, 601 bp, Homo sapiens
  misc_feature: GZ8MTXP01A4PAX.51.81.H04.1.454.CMB.2.raw
  modified_base (235)..(235): a, c, t, g, unknown or other
  modified_base (276)..(276): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtacagcagagccggcaggccctgtgttggngatgtataaagacactgagaggccctgagggactcccgtgagcgtattctcctggctccgaggtcgaagggaccaacggtcacgtagttcgggacctacgtcgtaggtggagtcccgaagggccaaggagggaaccggagggtctaggtacttattagttagtacaattacaaagacgaacctaaccgtagtttcggttaactttagtcgttaccgttacggtaacttggaaccgtaaccgttaacggtccttaccggtccgtggggttaccacggaccccgaacggccccaacccacgtcgttacctcgttccgtttaaccccg

SEQ ID NO: 434591 - DNA, 644 bp, Homo sapiens
  misc_feature: GZ8MTXP01E2KBC.51.81.H04.1.454.CMB.2.raw
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgtcttattggtaccagcagaagccggcacggccctgtgttggtgatagtaataaagacacgtgagacggaccctgagggactcccgtagacgcgtattcgtccgtaggctaccgagggtcgaaaaggggaccaacgggtcaactagttcgggaccctagtacgagggttggaacgtccgaaggggacaagggaggaccggaggtctagacttattagttgtaacaagtacaaacgacgtaaccaaccgttagttacggttaactttagttcgttaccgttaccgggaaacttcggaaccggtaaccgaaagggtcccaccgggttaccgtcggggttacgaccgaccccgtaaaccgggaccccaaaccccgtcgtacgttacctaaccgtttccgttaaccccg

SEQ ID NO: 434592 - DNA, 536 bp, Homo sapiens
  misc_feature: GZ8MTXP01ELVL5.51.81.H04.1.454.CMB.2.raw
  modified_base (235)..(235): a, c, t, g, unknown or other
  modified_base (353)..(353): a, c, t, g, unknown or other
  modified_base (416)..(416): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagagccggcagccctgtgtgtgatgtaataaagacactgagacggcctgagggactccgtagagcgtattctctggctcgaggtcgaagggacaacggtcanagttgaccatcgagtggagtccgagcagaggacgtaggctgacttatattagtacaatacaanagacacattggtacttagtcgtcgttacggaactgaacgacgaaagggtcttaaccgtcgtcgggttacacgacccgaaggccccaaacccgtgtcgttacctaaccgttcgtttccccg

SEQ ID NO: 434593 - DNA, 687 bp, Homo sapiens
  misc_feature: GZ8MTXP01EPEAT.51.81.H04.1.454.CMB.2.raw
  modified_base (217)..(217): a, c, t, g, unknown or other
  modified_base (234)..(234): a, c, t, g, unknown or other
  modified_base (290)..(290): a, c, t, g, unknown or other
  modified_base (661)..(661): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgganatgcattgaccaaacgnttatgtctttattggtaccagcagacgccggcacggccctgtgttggtgatgtaanaaagacacgtgagacggcccctgagggacttcccgtaggacgtcgtactttcctccgtcggtacttaccggagggttaccgaaaacggggaacctaaccggggtcaaaccgtacgtttcgggacccttaagtccgtaaagggttcgggaacgttacccggaagggaccgaagggaacgggtaaccggagggtcctaagggtaacttaacgtttaatagttaaccaaagtacaaacggtaaacgacctaaacccgtaagtttacgggttaacctttaagttcgttacgtttacgggaacttggaaccgtacgttaaacgggtcccttaccggtcgtgggttacccacgacccgaacggtacccaaccccgtntacgttcctaaccttccgttccccgg

SEQ ID NO: 434594 - DNA, 568 bp, Homo sapiens
  misc_feature: GZ8MTXP01AX0YF.51.81.H04.1.454.CMB.2.raw
  modified_base (241)..(241): a, c, t, g, unknown or other
  modified_base (287)..(287): a, c, t, g, unknown or other
  modified_base (558)..(558): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaacgntatgcttatggtaccagcagaacgccggccaggccctgtggttggngatgtaataagacacgtgagacggccctagagggactccgtgacgcgtacttctcgtggcctcgaaggtcgaagggacaacgggcactagttcggcatcgaggtggacgtccgaaggcgaaggacggacggaggcgtagtaacttagtttagttacggtactaaataccaaacgacgtaaccacctagtttacggtaacttagtcgttcgtacggaacgtgaccggtaccaaggtccaccgttcgttggttcaacgccaacggcccaaccnctcgctaacc

SEQ ID NO: 434595 - DNA, 583 bp, Homo sapiens
  misc_feature: GZ8MTXP01AZY12.51.81.H04.1.454.CMB.2.raw
  modified_base (218)..(218): a, c, t, g, unknown or other
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgcattgaccaaacgntatgcttatggtacagcagaagccggcacggccctgtgttggtgatgtaataaagacactgagacggcctcgagggactcccgtgagcgacttctccgtggctccgaggtcgaagggacaacggtcacgtagttcggccatcgagtggacgtaccgagggcaggaggacgaggtctagacttattactgtacaagtacaaactacgacctaccgtattcggtaactttagtcgttcgttacggaacgttcgaaccgaaccgttaggtccacccggttcgtacgggttccgacgaccccgaacggaccccaaccccgtactcggttaccctaacgttccgttaaccccg

SEQ ID NO: 434596 - DNA, 610 bp, Homo sapiens
  misc_feature: GZ8MTXP01BEC7I.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagatgcattcgacccaaaccgatatgcttattggtaccagcagaacgcccgggccacggccctggtgttggtgatgtaataaagcactgagacggccctgagggactcccgtgacgcgtacttctcgtggcctccgaagggtcgaaggggacaacgggtcacgtagttcggacctagtcgagtggacgtccgaggacgaggacgggacgaggctagtaacttagtttagttaggtactaatacaacgagaacctaccttagttacggttaactttagtcgttaccttacggaacgttcgaccgtaaccgttaacggtacccgtaccgttccggttggttaccgaaccgacccgaacggacccccaacccgttactcgttccgtaacccg

SEQ ID NO: 434597 - DNA, 605 bp, Homo sapiens
  misc_feature: GZ8MTXP01APYJI.51.81.H04.1.454.CMB.2.raw
  modified_base (219)..(219): a, c, t, g, unknown or other
  modified_base (236)..(236): a, c, t, g, unknown or other
  modified_base (276)..(276): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttatggtaccagcagacgcggcagccctgtgtggngatgtaataaagacatgagacggcctcgagggtactccgtagacgcgtatctcgtgctcgaggtcgaagggacaacggtcacgtagttggaccagtcaagggttcggacgtccgagggacagggaggtaacggaggtctagtattattatagtacaagtacaaagtacgaacctaacgtgttaggtactttagtcgttacgttacggaaacctgaaccgtaaccgttaaacggtcccgttaacccggttccggttacgggaccgcggaacccccgaaccgggtaccccgaaacccctacgttcgacccttaaccttcccggttcccccg

SEQ ID NO: 434598 - DNA, 678 bp, Homo sapiens
  misc_feature: GZ8MTXP01ERTOO.51.81.H04.1.454.CMB.2.raw
  modified_base (286)..(286): a, c, t, g, unknown or other
  modified_base (288)..(288): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattgtaccagcagaacgccgggaccacggccctgtgtgtnangttaataaagacactagagacgccctcgagggactcccgtagacgtccgtacttcgtcgtcgtccgtaaccgtacggtaacggaacgggaacgaacgtacgtacgtacgtacgactacgtacgtaggtacggtacggtacgacggacggaacggaacgggacggaacggtacgtacgtaacgttaattaagttacgttaacgtaaactaacgaaaccgaaacgtaaccgtaacgttaacgttacgttaacgttaacgttacgttacgttaacggtaacgttacgtaaccgttaaaccgtaaaccggtaacccgttacccggttcccggttaccggtaaccgacccgaacccgaacccgaacccgaaccccgtaaccgttaaccgtaaccg

SEQ ID NO: 434599 - DNA, 584 bp, Homo sapiens
  misc_feature: GZ8MTXP01CODXI.51.81.H04.1.454.CMB.2.raw
  modified_base (240)..(240): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattcgaccaaacgntatgcttatggtacagcagaacgccggcacggccctgtgtgtgatgtataagacactgagacggccctgagggactcccgtgacgcgtacttctcgtggcctaccgaaggtccgaagggacaaacgggtcacgtagttcggaccatcgagtggacgtccgaggacgaggacggacgtaggctagaactagtttagttggtactaaagtcaaacgtacgacctactagtttacggtaacttagtcgtacgttcggaaacttgaccgtacaaggtcctaccgttccgttagggttaccaacggtaccccgaacggcccctaacccgttacgtcgttaacttaaccg

SEQ ID NO: 434600 - DNA, 538 bp, Homo sapiens
  misc_feature: GZ8MTXP01BER9R.51.81.H04.1.454.CMB.2.raw
  modified_base (235)..(235): a, c, t, g, unknown or other
  modified_base (279)..(279): a, c, t, g, unknown or other
  modified_base (469)..(469): a, c, t, g, unknown or other
  modified_base (489)..(489): a, c, t, g, unknown or other
  modified_base (519)..(519): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgtcttatggtaccagcagaagccggcaggccctgtgttggngatgtataaagacactgagaggcccctgagggactcccgtggacgcgattctccgtcggctccgaggtacgaacgggacaacggtcaacgtagttcgggacctagtcgaggtgggacgtccgaaggcaaggagggacgaggctaggacttattatagtacaatacgaactagacactagttgtacttatntcgtagactgcgacagtccncgtcgtggcgcgacccaacggcccaacccnctcgctaacttcgttcccg

SEQ ID NO: 434601 - DNA, 765 bp, Homo sapiens
  misc_feature: GZ8MTXP01BQ9JY.51.81.H04.1.454.CMB.2.raw
  modified_base (222)..(222): a, c, t, g, unknown or other
  modified_base (258)..(258): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggatcactgctcgtgganatgcattcgaccaaacgatatgtcttatcggtacancagaagccggcacggccctgtgtggtgatagtaataaagacacgtagacgacggcccgtagagggactcccgtagacgtcgtacttccgtcgtcggtacctccggtaaacgggttaccgaacgggggaaaccgtaaaccgggttccgtaaacgtacggtttccggggacctaacgttaccggtagggttacgggaacggtacccgaagggtacggaaacggggaacgggaacggaacgggtccgtaagttaacttaagtttacgttacggtaacgtaaacttaaccgaaacggtaacgtaaccctaaccgtttaagtttaccggttaaaccttttaggttaccgtttaccggttaaccggtaaaccgttcggttaacccggtaaacccgttaacggggttaacccctacccggggttaccgttaccggggttaccgaacccggtaacccccggaaaccggacccccgtaaaccccttacggttaacccgttaaccgtttaacccccg

SEQ ID NO: 434602 - DNA, 709 bp, Homo sapiens
  misc_feature: GZ8MTXP01AQW8K.51.81.H04.1.454.CMB.2.raw
  modified_base (220)..(220): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacacgccaccctggtgtcagtcgtccccaggacagacggccaggatcacctgctcgtgganatgctattcgaccaaacgtatatgtcttagttcggtaccagcgaaggaacgcccgggcacggtccctggtggttggtgtatagtaaagaaagacacgtaggagacggtccctacggagggtactcccgtagacgtcgtactttctccgtcggtcctacggtacgggtacggaaacgggaaccgtaacgggtctaaacgtacgttcggactagtacgaggtacggacgtccgaagggcgaaggacgggaacggaggtacgtacgtaacttagtttacgttagtaacaaacgtacaaacgtaacgtaacctacttaagtttcggttaactttagttacggttacttacgggtaaacctcggtaaccgtaaaccggttacggtaccccgttaccggttccggttacggggacccgaccgggaaccccaaacccgggtacccctaaaccccgttccgtacggttaccctaaccgtttccccgtttcccccggg

SEQ ID NO: 434603 - DNA, 677 bp, Homo sapiens
  misc_feature: GZ8MTXP01DSVDY.51.81.H04.1.454.CMB.2.raw
  modified_base (218)..(218): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatcacctgctctgganatgcattcgaccaaacgtatatgtcttagtcgtacagcagacgccggcaggccctagtgttggtgatgtaaataaagacacgtgaacgacgcctagacgggtactcccgtgacgtcgtattcctcgcggtctacgacggtcgaaacggggaactaaccgggtcaaacgtagttaccgggaccctagtccggtaaggttacggaacggtacccgagggacgaacgggaagggaacggagggtctaaggtacttaagttaacttagtaaccctaaagttacccgaaaacgtaaccgtaacctaacgttacgtttacggtttaacgtttaacgttcgttaccgttacggtaacgtcggaaccgtaacggttaacggttacccgttaccggtccgtacggttaccgaccgaacccgaaccgaccctaacccgtacgtacgttacctaaccgttcccgttcccg

SEQ ID NO: 434604 - DNA, 714 bp, Homo sapiens
  misc_feature: GZ8MTXP01DVFX4.51.81.H04.1.454.CMB.2.raw
  modified_base (241)..(241): a, c, t, g, unknown or other
  modified_base (302)..(302): a, c, t, g, unknown or other
tcagcgatcgtatacacgaccggtgctcgatttagtagtgtagattcgcggggggtgggtccaggaggcagaactctgggtgtctcaccatggcctggatccctctacttctccccctcctcactctctgcacaggctctgacggcctcctatgagctgacacagccaccctggtgtcagtcgtccccaggacagacggccaggatcacctgctcgtggagatgctattcgaccaaaacgntatgctttatgtaccagacagaacgcggcacggcctgtgtgtgatgtaaataaagactacngagacggcccctagacgggactccgtgacgtcgtatctcgtggactccgagtacgaaagggactaacggtctaaacgtagttacgggactaacgtcgaaggttacggacgtacccggaacgggacgaaagggacggtaaaccgggaacgggtacttacggtaactttaaagttaagtttacgaaactaaaacggttaacgaaaaccgtaaacgaacccgtaaaccttaacgtttaggttaaacctttaaagttcgttaaccgttttaacgggaaaccttggaaaccgtaaccggttaaacgggtacccttaaccggtttaccggcggggttaacccaccgaaaccccgaaaccgggtaaccccaaaccccggtaccgtaccgttaccgtaaccgtttcccgtttaacccccg

SEQ ID NO: 434605 - DNA, 664 bp, Homo sapiens
  misc_feature: GZ8MTXP01AW346.51.81.H04.1.454.CMB.2.raw
  modified_base (221)..(221): a, c, t, g, unknown or other
  modified_base (240)..(240): a, c, t, g, unknown or other
  modified_base (284)..(284): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctgganatgctattcgaccaaacgntatgcttatcggtacagcagaacgccggcaggccctgtgttggngatgtaataagacatgagcggccctgagggactcctgacgcgtacttcctcgtcggcctaccgaaggtcgaagggaacctaacgggtcacgtagttcgggactagtcgaggtcggacgtccggaggacgaaggacgggacgaggcttacgtaacttagtttaagttcggggtaactaactaaccgaaacgaacgtaaccctaaccttaagtttacggttaacttagttacgttccgttaacgggaaacgttcggacccggtaaaccgttaaacgggttacccgtaaccccggttccggttcggggttacccaacccgggtaccccgtaaaaccgggaccccctaaacccccgttacgttccggttccccgtttaaccccg

SEQ ID NO: 434606 - DNA, 645 bp, Homo sapiens
  misc_feature: GZ8MTXP01BW7PA.51.81.H04.1.454.CMB.2.raw
  modified_base (223)..(223): a, c, t, g, unknown or other
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggccaggatcacctgctcgtgganatgctattcgaccaaaccgtattatgtactttagtcggtaccagcgaaggaacggcccgggaccgacgggtccccgtggttcggttggtagtaagttagtaaagtaaaggactaacgtggaacggaccggccccgtaggacggggtacctcccggtaggacgcgtactttccgtccggtcggtcctaccggacggtcggaaacgggaacctaacgggtcaacgtacgttcggacctagtcgaggtggacgtcagggcaggacggacgagctagtactattagtagtacaatacgaatacactactagttagtattagtcgtctacggactgaaccgaacgacggtacaccggtcgtcggttccgacggaccccaacgggacccctaacccgtcgtcgttacccgtaaccgttccgttccccg

SEQ ID NO: 434607 - DNA, 661 bp, Homo sapiens
  misc_feature: GZ8MTXP01EAJSS.51.81.H04.1.454.CMB.2.raw
  modified_base (218)..(218): a, c, t, g, unknown or other
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatcacctgctctgganatgcattgaccaaaacgntatgtacttagttggtaccagcagaacgccggcacggccctgtgttggtagatagtaataaagacagtagaacggacgcccctagacgggtaactcccgtgacgcgtattcctccgtcggcttaccgaggtacgaaacgggaactaacgggtcaacgtacgttcggaccctagttacgaggttacggacgtacccgaagggaccgaagggaagggaccggaggtactagggtaacttaagttagtttaacgactaaacgtacaaacgaaacgaacctaaaccgtagtttacggttaactttaaagtcgtttaccgttacgtaacttcggaacccgtaaacgttacgggtccttaccgtcgtcgggttacacgaccccgaaaggccccctaaacctcggtacttcctaaccgttccgttaaccccg

SEQ ID NO: 434608 - DNA, 615 bp, Homo sapiens
  misc_feature: GZ8MTXP01CJHIM.51.81.H04.1.454.CMB.2.raw
  modified_base (382)..(382): a, c, t, g, unknown or other
  modified_base (588)..(588): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgctattgaccaaacgatatgcttattggtaccagcagaacggccggccacggcccctgtgttggtgatgtataaagacacgtgagacggcccgtcgagggtactccgtagacgcgtattctccgtcggctaccgaggtacgaagggaccaacggtcaaacngttcggactactcgaggtggagtaccgaggcgaaggagggacgagggtctagacttagttaagttgtacaacgttcaaacgagacctaaccttagttacggttaactttagtcgttacgttacggtaactcggaaccgtaacgttaagggtcccgacgttaccgtcgggttaaccgccgttacccgaaccggaccccaacccgtcnccgttaccaacgtttcccttaaccccg

SEQ ID NO: 434609 - DNA, 613 bp, Homo sapiens
  misc_feature: GZ8MTXP01A9WIG.51.81.H04.1.454.CMB.2.raw
  modified_base (220)..(220): a, c, t, g, unknown or other
  modified_base (238)..(238): a, c, t, g, unknown or other
  modified_base (325)..(325): a, c, t, g, unknown or other
  modified_base (581)..(581): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgctattgaccaaacgntatgcttatgtaccagcagaagccggccaggcccctgtgttggtgatagtaataaagacactgagacggccctcgagggactcccgngagcgattcgtcgtggctccgaggtccgaagggacaacggtcactagttcggaccatacgaggtggacgtccgaagggcgaaggaggaccggaggactaggacttattattagtacctaaacgtacaaacgtaacgaactaacctagtttcgtaactttagttgtccgttacgtaaacgttcggaaccgaaccgttaacggtccgaacccggtcccgtggggttaccacggaccccgaaacgggcccccaaacccnccgttacgttcctaaccgttcccgtttccccg

SEQ ID NO: 434610 - DNA, 616 bp, Homo sapiens
  misc_feature: GZ8MTXP01EPSKO.51.81.H04.1.454.CMB.2.raw
  modified_base (235)..(235): a, c, t, g, unknown or other
  modified_base (278)..(278): a, c, t, g, unknown or other
tcagcgatcgtatacacgaccggtgctcgatttagtagtgtagattcgcgggggtgggtccaggaggcagaactctgggtgtctcaccatggcccggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtacagcagaagccggcaggccctgtgtggtnatgtaataaagacactgagaggccctcgagggactcccgtgagcgtattctctcggcctcgaggtcacgggaacaacggtcacagttggccattcgaggtggaagtccgaggcgaggaggagaagggctagtactaagttattgtacaatacgaacaagacctaccgtaagtttcggtaactttaagttcgttcgttacgggaaacttcgaccggaacccgtaaagggttcccaaacccggttccgttacgggggtaccaacggttcccccgaaaacgggtaacccccaaacccctaacgttccggtaccttaccgttccttccggttttaacccccc

SEQ ID NO: 434611 - DNA, 574 bp, Homo sapiens
  misc_feature: GZ8MTXP01B7RTZ.51.81.H04.1.454.CMB.2.raw
  modified_base (218)..(218): a, c, t, g, unknown or other
  modified_base (234)..(234): a, c, t, g, unknown or other
  modified_base (274)..(274): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggantgcattgaccaaacgntatgcttatggtaccagcagagccggcagccctgtgtggngatgtaataaagacactggacgacggccctagagggactcccgtgacgcgtattctccgtggctccgaggtcgaaacggggacaacgggtcaaccgagttcggacctagtcgaggttcggagtaccgaggcaggaggtacgaggctagacttattatgtacaagtcaacacgactacatttggtaacttgtcgttcttacggaactgaaccgaaacgttacgggtccttaaccggttcgtcgggaccacgaccccgaacgggaccccaacccgacttcggacctaaccgttcgttccccg

SEQ ID NO: 434612 - DNA, 555 bp, Homo sapiens
  misc_feature: GZ8MTXP01C78AD.51.81.H04.1.454.CMB.2.raw
  modified_base (455)..(455): a, c, t, g, unknown or other
  modified_base (541)..(541): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgatctgacacagccaccctcggtgtcagtgtccccaggacagacggccaggatcacctgctctggagatgcattgaccaaacgatatgcttattggtaccagcagaaggccggcacggccctgtgtggtgatgtaataaagacactgagacggccctcgagggatcccgtgacgcgtacttcctcgtggcctcgaacgggtacgaaggggtaccgaaacgggttcactagttcgggccagtcagtggaacgtcgagcgaaggaggacgtagctagacttattattggtacaatacaacganacactattaggtacttatgtcgttcggaaactgaccgacgaacgtcgaccgttcgttgggttcaacgacccgaagaccccaacccncgttaagcctaacc

SEQ ID NO: 434613 - DNA, 628 bp, Homo sapiens
  misc_feature: GZ8MTXP01COZS3.51.81.H04.1.454.CMB.2.raw
tcagcgatcgtatacacgaccggtgctcgatttagtagtgtagattcgcggggggtgggtccaggaggcagaactctgggtgtctcaccatggcctggatccctctacttctccccctcctcactctctgcacaggctctgaggcctcctatgagctgacacagccaccctcggtgtcagtcgtcccaggacaggacggcaggatcacctgctcgtggagatgactattacgaccaaacgtattatgtctttagttcggtacagcaggaacgccgggcacggccctggtgttggtgatagtaataaagacagtgaggacgccctgacgggactcctggacgcgtacttctcgtcggctcgaggtaccgaaagggacgaacggtcacgtagttcggacagtacgaggtgacgtccgaggacgaggacgggacgtacggtcgtagtacgttatttagttacgactaacggtacaaacgtacgaacctaccgtagtttcggttaactttacgtggttaccgttacggtacgttgaacccggtaaccgagggttcccaccggtaccgttggttaccgacgaccccggtaacgccccaaacccgtcgtaccgactaacccttcgttaaccccg

SEQ ID NO: 434614 - DNA, 576 bp, Homo sapiens
  misc_feature: GZ8MTXP01D58YB.51.81.H04.1.454.CMB.2.raw
  modified_base (218)..(218): a, c, t, g, unknown or other
  modified_base (235)..(235): a, c, t, g, unknown or other
  modified_base (552)..(552): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatgtaccagcagaagccggcacggccctgtgttggtgatgtaataaagacatgagacggccctagagggactcccgtagacgcgtattctccgtcggctcgacggtcgaaagggaaccaacggtcactagttcggaccatcgaggtcggagtaccagggcgaaggaggacgaggctgaacttagttattagtactaactacaaactacgaacaacctagttacggttattagtgttacgtacggtaactggcgaaccgttaaggtccaccgtcgtcgggttccacggacccgaacggcccaaaccccgtntcgttctaaccttcgttaaccccg

SEQ ID NO: 434615 - DNA, 682 bp, Homo sapiens
  misc_feature: GZ8MTXP01DC9SK.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggactcacctgctcgtggagatgctattcgaccaaacgtatatgtctttagtcgtacagcgagaacgccggcacggtccctgtgttgagatagtaataaagacagtagagacggccctacgagggtactccgtgacgcgtacttctccgtcgctcgacggtacgaacgggaacgtaacggtcaacgtagttcggacctagtcgaaggtcggacgtaccgagggacgaagggaagggaccggtaaggtctacggtaacttagttaacttacgtaactaaacgtacaaaacgacggtaaacctaaccgtaagtttacggttactttaaacttcggttaacgttaccgggtaaacgttcggaaccggttaaccgaaacgggtaccttaacccggttcggttaaccggttaccgaccgaaaccccggtaaccggaacccctaaccccgtacgttaccgttaccttaacccttccgtttcccccg

SEQ ID NO: 434616 - DNA, 535 bp, Homo sapiens
  misc_feature: GZ8MTXP01DPNIC.51.81.H04.1.454.CMB.2.raw
  modified_base (218)..(218): a, c, t, g, unknown or other
  modified_base (496)..(496): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgatatgcttattggtaccagcagaagccggcaggccctgtgttggtgatgtaataaagacactgagaggccctgagggactccgtgagcgattcgtcgtggctccgaggtcgaaagggacaacgggtcaacgattcgggacccagtcaggttggagtccgaggcagaggacgaggctagactattattagtacaagtcaaactacgacacctagttgtacttagtgtcttacggaactgcaacgaagtccacgtctgggttcnccgaccgaagcccaaccactcgttctaacttcgttcccg

SEQ ID NO: 434617 - DNA, 646 bp, Homo sapiens
  misc_feature: GZ8MTXP01EK9X3.51.81.H04.1.454.CMB.2.raw
  modified_base (234)..(234): a, c, t, g, unknown or other
  modified_base (271)..(271): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgntatgcttatggtacagcagagcggcagccctgtgtgnatgtataaagacacgtgagacgcctgacgggatccgtggagcgtattctcgtcggctccgaggtcgaaagggacctaacggtcaacgtattacgggccctaagttccgaagggttcgggaacgttacccgagggaccgaagggtaacgggaaccggagggtacctacggtaactttaagttaattacggttaacaaacgttacaaacgaacgtaacctaaccgtagtttacggttaacttaagttcgttacgttacgggtaactggaaccggtaaccgttaaaggtccgttaacccggtccgttacgggaccgacgaccccgaacgggacccctaaacccccgttcgtaccgttaccttaaccgttcccgtcccg

SEQ ID NO: 434618 - DNA, 643 bp, Homo sapiens
  misc_feature: GZ8MTXP01BSRNH.51.81.H04.1.454.CMB.2.raw
  modified_base (204)..(204): a, c, t, g, unknown or other
  modified_base (238)..(238): a, c, t, g, unknown or other
  modified_base (257)..(257): a, c, t, g, unknown or other
  modified_base (292)..(292): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggntcacctgctctggagatgcattcgaccaaaccgntatgtacttatggtacagnacgaagccggcaggccctgtgtgtgatgaataaancactgagacggccctagagggctccgtgacgtcgtattctcgtcggctcgacggtcgaacgggtacaacgggtcaacgtagttcgggacctagtacgtacgggtacggacgtcccggaagggacgaacgggaaggaacgggaggtaccgtaggtaacttagttagttacgtaacaaacgttacaaacgaacgaacctaacgtacgtttacggttactttaacgtcgttaccgttaccgggtaacttcggaacccgtaacgttaaacgggtcccgttaccgttccggtcgggttaccaccggaccccgaacgaccccaaccctctcgttacctaaccgttcccgtttccccg

SEQ ID NO: 434619 - DNA, 678 bp, Homo sapiens
  misc_feature: GZ8MTXP01AKSH3.51.81.H04.1.454.CMB.2.raw
  modified_base (243)..(243): a, c, t, g, unknown or other
  modified_base (298)..(298): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtggagatgcattcgaccaaacgntatgcttattcgtaccagcagaacggccggcacggccctgtgtggtgatagtaanaaagacacgtaggagacggccctgagggtactccgtgacgcgtacttcgtcgtcgcctacgtaacgggtcgaacgggaaccgaacgggtcacgtagttacggactagtacgaggtacggacgtccggaaggacgaagggacgggacggaggtaccgttacggtaactttagtttaagttacgggtaactaaacgttaccaaaacgtaacgaaccgtaaccttagtttaacgggttacctttaagttcgttacgtttacggaaacttcggaaccgtaaccggttaaacggttcccgtaacccggttccggttacgggttcccaaccggaccccgaacccggtaccccaaaaccccgttcgtaaccgttaaccgtaaccccg

SEQ ID NO: 434620 - DNA, 561 bp, Homo sapiens
  misc_feature: GZ8MTXP01EFW6R.51.81.H04.1.454.CMB.2.raw
  modified_base (250)..(250): a, c, t, g, unknown or other
  modified_base (261)..(261): a, c, t, g, unknown or other
  modified_base (434)..(434): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattgaccaaacgatatgcttatgtaccngcagagcggtnacggccctgtgtgtgatagtaataaagacactgagacgccctgagggtactccgtgacgcgtattctccgtggctcgaggtcgaaacgggaacaacgggtcaacgtacgttcggaccatcgaggtggacgtaccgaggcgaggaaggtacgaggctagacttattattagtanaactacgaacagacaccgtattacgtattatcgtacgttacgactcgaacgtaacgaggtccttaccgtcgtcgggacaccgacccgaacggacccaaccctagtcttacctaaccttcgttccccg

SEQ ID NO: 434621 - DNA, 661 bp, Homo sapiens
  misc_feature: GZ8MTXP01B89MW.51.81.H04.1.454.CMB.2.raw
  modified_base (236)..(236): a, c, t, g, unknown or other
  modified_base (291)..(291): a, c, t, g, unknown or other
  modified_base (312)..(312): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattcgaccaaacgntatgtcttatggtaccagcagagccggcacgccctgtgtggtgatgtaataaganactgagcgcctcgagggtacnccgtagacgcgattctcctggctccgaggtcgaacgggaacaacggtcaacacgttcgggaccctagtcgaagtacggacgtaccgagggacgaaggaacggggaaccggaagggtcctaagggtaaacttatttaagttacgtacaaacgttcaaaacgaacgtaaacctaacctaagttacgggttaacttaagttcgttacgtttacgggaaacttcgtaaacccggaacccgttaaagggttaccccgttaaccggttccggttaggggttacccgttaaccgaccccgaaacgggtaccccaaaccccagttccggttaccctaaccttcccgtttaacccccg

SEQ ID NO: 434622 - DNA, 645 bp, Homo sapiens
  misc_feature: GZ8MTXP01D51ZA.51.81.H04.1.454.CMB.2.raw
  modified_base (219)..(219): a, c, t, g, unknown or other
  modified_base (236)..(236): a, c, t, g, unknown or other
  modified_base (315)..(315): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttatgaccagcagaagccggcacggccctgtgtgtgatgtaataaagacactgagacgcctcgagggactccgngacgcgtattctcgtggctcgaggtcgaaagggacaacggtcaacgtagttcgggacctagtcgtaagggttcggaacgtcccgaagggaccgaagggaacgggtaacggacgggtcctaggtaaccttaagtttaagttacgtaacaaacgttacaaaactaacggaacctaaccgttaagtttacgggtttaaacctttaagttcgttaccgtttaccggaacttcggaaccgtaaccgttaaacgggtccttaacccgtcgtacggggttccacgaccccgaacggacccctaaacccctcgtcttacctaaccgttcttaaccccg

SEQ ID NO: 434623 - DNA, 558 bp, Homo sapiens
  misc_feature: GZ8MTXP01CGYSZ.51.81.H04.1.454.CMB.2.raw
  modified_base (426)..(426): a, c, t, g, unknown or other
  modified_base (446)..(446): a, c, t, g, unknown or other
  modified_base (547)..(547): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaacgatatgacttatggacagcaagaacgccggcacggccctgtgtgtgatagtaataaagactacgtgaggacgtccctagagggtactccgtagaggtcgtacttcgtcgtaggctacgaagggtcgaacggacaacgggtacatagtcggctaagtcaggtaggacgcgagacgaaggacgagagtntagtatattatacgactaanacaacgactactacttagttacgtattagtcgtacgtacggaactggaccgtacgacgtccgtcgttcgttcgaccaaccgaccgaaccgacccaccgttntccgcctaacg

SEQ ID NO: 434624 - DNA, 718 bp, Homo sapiens
  misc_feature: GZ8MTXP01D7TXJ.51.81.H04.1.454.CMB.2.raw
  modified_base (239)..(239): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctctatgagctgacacagccaccctcggtgtcagtcgtccccaggacaggacggccaggatcacctgctcgtggagatgctattcgaccaaacgntatgtactttagtggaccagcgaagaacggcccggcacggtccctgtggttggtgatgtaaataaagacacgtggaacgacggcccctagaacggggtactcccgtagacgtcgtattccgtcgtcggctacgaggtacgaaacggggaacctaacgggtcaacgtacgttacggaccctaagttccgaaggttaggacgtaccggaagggactaagggacggaacggtaggtacctaggtaacttaattagttacgtaactaaacgtaacaaacggaacgtaacctaaccgtaagtttaggttaaccttaagttcgtaccgtttaacggaaccgttaggaaccgtaaaccgttaacggttacccgttaacccggttccggttacggggttacccttaaccggaccccggaaaccggttacccccgaaaaccccttcgggtaacccgttcccgtaacccgtttcccgtttccccccggg

SEQ ID NO: 434625 - DNA, 619 bp, Homo sapiens
  misc_feature: GZ8MTXP01DZ8BR.51.81.H04.1.454.CMB.2.raw
  modified_base (286)..(286): a, c, t, g, unknown or other
tcagcgatcgtatacacgaccggtgctcgatttagtagtgtagattcgcggggggtgggtccaggaggcagaactctgggtgtctcaccatggcctggatccctctacttctccccctcctcactctctgcacaggctctgaggcctcctatgagctgacacacgccacctcggtgtcagtcgtccccaggacagacggcaggatcactgctcgtggagatgactattcgaccaaacgtattatgtacttagtgaccagacagacgccggcacggtcctgtgtgtnatgtaataagcagtgagacgcctagaggtactccgtagacgtctacttcgtccgtcggtcctacgacggtacgaaacgggaactaacggtcaacgtagttcggactagtacgtaggtacgacgtaccgaggacgaggaggaacgaggtctagtacttagttacgtacgtaaactacgtaacaacgtaacgacttaccgtagtttacgttatttagtcgttacgtacgaacgtcggtaaccgtaacgttacggttccacggtaccgtggttaccgcccggttaacccgaaccgaacccctaaccgtactcgttacctaaccttccgttaacccc

SEQ ID NO: 434626 - DNA, 662 bp, Homo sapiens
  misc_feature: GZ8MTXP01BR5B0.51.81.H04.1.454.CMB.2.raw
  modified_base (221)..(221): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctgganatgcattcgaccaaaccgtatatgtactttattggtaccagcagaagccggcaggcccctgtgttggtgatgtaataaagacacgtgagacggccctacgagggactcccgtgacgcgattctccgtggctccgaggtcgaacgggaaccgaacgggtcaacgtagttcggaccatcgaggttcggacgtcccgagggacaagggagggaacggagggtccgtaggaacttagttagttagtacaaagttacaaactaacggaacctaacctaagttacgggttaactttaacgttcgttaccgttacggtaaacgtcggtaaccgtaaaccgttaacgggttacccgaacccggttccgtacggggttaccgacccggaccccgaaaccgggacccccaaaccccgtacgtccggttacctaaccttcgtttaacccccg

SEQ ID NO: 434627 - DNA, 520 bp, Homo sapiens
  misc_feature: GZ8MTXP01DK6SS.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccgggcacggccctgtgtggtgatgaataaagcacgtgagaggccctgagggactccgtgacgcgattctccgtggctcgaggtcgaaagggacaacggtcaactagttcgggccatcaggtcggagtccgagggcaggaggacgagctagacttatatgacaagtcaaacagaacactattgtacttatgtcttagactgcaacagtcacgtcgtggttcgcgacccaaggacccaacccactcgactaacgttctcccg

SEQ ID NO: 434628 - DNA, 568 bp, Homo sapiens
  misc_feature: GZ8MTXP01CIKWN.51.81.H04.1.454.CMB.2.raw
  modified_base (219)..(219): a, c, t, g, unknown or other
  modified_base (236)..(236): a, c, t, g, unknown or other
  modified_base (279)..(279): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttatgtacagcagagcggcacgcctgtgtgtgatgtanaagacacgtgagcgcctgagggctccgtgagcgtacttcgtccgtcggctacgaggtacgaaacgggaaccaacggtcacgtagttcggacctagtacgaggttggacgtaccgaggcgaaggacgggacgacggtctaggaacttattatgtacaattacaactacgactactagttgtacttagtcgtacgtacggactcggaacgtaacgaggtaccgacgtccggttcggacgaccgacccgtaacgaccctaacccgacgtcgacctaaccttccgttaacccg

SEQ ID NO: 434629 - DNA, 547 bp, Homo sapiens
  misc_feature: GZ8MTXP01ESAGQ.51.81.H04.1.454.CMB.2.raw
  modified_base (217)..(217): a, c, t, g, unknown or other
  modified_base (274)..(274): a, c, t, g, unknown or other
  modified_base (527)..(527): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgaccaaacgatatgcttatgtaccagcagagccggcacggccctgtgtgngtatgaataagacagtagagacggccctgagggactcccgtagacgcgtattctcgtggctcgaggtccgaagggaacctaacggtcaacgtacgttcgggcctagttcgaaggtggaacgtccgaaggcgaagaggtacgagtctgacttattatagacaagtacaaagtagacactagttggtacttatcgtacttaggaactggaacgacaaggtcttaccgtcgtggcacgacccaacggtcccaaccngtacttcaacgttcgtcccg

SEQ ID NO: 434630 - DNA, 737 bp, Homo sapiens
  misc_feature: GZ8MTXP01A7O2S.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattcgaccaaaccgatatgcttattggacagcagacgccggcacggccctgtgtggtgatgtaataaagacacgtagacgacggccctacgagggtactcccgtgacgcgtacttctcgtcggctccgaacgggtcgaagggactaaacgggtcaacgtagttcgggacctagtacgacgtagggtacggtaccgaacgggacgaacgggaacgggacgggacgggtacgtacgtaagttaaccccccccccgtttaagtttacggggttaacgtaaacgttaacctaaaaccgaaacgtaaaccgtaaacccgttaacgttttaacggtttaaccgttttaacgttacggtttaccgtttaccgggtaaaccgttacggttaccggtaaacccggttaaaccggtacccgtacccggttacccggttaccggggttaccggtaacccggtaccccgaacccgggaccccgaaacccccgttaacccgttccgttaaccgttaaccccg

SEQ ID NO: 434631 - DNA, 660 bp, Homo sapiens
  misc_feature: GZ8MTXP01A358K.51.81.H04.1.454.CMB.2.raw
  modified_base (174)..(174): a, c, t, g, unknown or other
  modified_base (602)..(602): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtntcagtcgtccccaggacagacggccaggatccacctgctcgtggagatgactattcgacccaaacgattatgtcttagtgtaccagcagacgccggcacggccctgtgtggtgatgtaataaagacactagagacggtccctcgagggtctaccgtgagtcgtacttcgtccgtcggctcgaggtcgaaacgggacgtaacggtcactagttcgacctagtcgaacggtgtacgaccgaggcgaaggacggaacggacggtgtacgtaacttaattaagttacgtaacctaaacgtaactaaacgaaacggtaacctaacccgttaagtttaccgtttaacgtttacgttacgttacccgttacggtaaacccgtggtaaacccgaaccggttaaacggtccccgttaaccgtccggttccggggacnccggaccccgaacggtaccccaacccgtactcgttaccctaacgttccttaacccccg

SEQ ID NO: 434632 - DNA, 643 bp, Homo sapiens
  misc_feature: GZ8MTXP01A3XAL.51.81.H04.1.454.CMB.2.raw
  modified_base (224)..(224): a, c, t, g, unknown or other
  modified_base (242)..(242): a, c, t, g, unknown or other
  modified_base (619)..(619): a, c, t, g, unknown or other
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacacgcccaccctcggtgtcagtcgtccccaggacagacggccaggatccacctgctcgtgganatgcattcgaccaaacgntatgtctttagtggtaccagcagacgccggcacggccctggtgtggtgatgtaataaagacacgtagacggacggtccccgtagacgggcctcccgtagacggcgtactttccgtccgtcggtccgtaccgtaggggtcgaaacgggaacccgtaacggtaccaactacggttcggacctatacgtagggtacggaccgtaccgagggccgaagggaacgggacggacgtcgtacggtaacttagttattacgtaactaataaccgaactaacggaacctaacgtgttacggtttacttagttcgttacgtacgtacgtcgaacgtaccgaaggttccaccgtcggtcggaccacgacccgaaccggcccaacccgntcgttaccctcgttccgttccccg

SEQ ID NO: 434633 - DNA, 738 bp, Homo sapiens
  misc_feature: GZ8MTXP01AWG8J.51.81.H04.1.454.CMB.2.raw
  modified_base (223)..(223): a, c, t, g, unknown or other
  modified_base (242)..(242): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggatcacctgctcgtgganatgctattcgaccaaacgntatgtcttagttcggtaaccagcgaagaacggcccgggaccacggtcccctggtggttggtagtatagtaaataaacgctacgtaggacgacggccccttgacggggtcttcccgtgacgcgtacttccgtcgtcggcctcccgaaagggtccgaacgggaactaacgggtcaactacgttcgggaccctagtacctaggtaggtacggtacccgagggaccgaaagggaacggggttaaccggacgggtaccgttaacggtaacctttagttttaaaccttaggggtttaacccaaaacgttaaccgaaaaccgtaacgaacccgtaaaccctttaacggtttagggtttaaacctttacgtttacggttaccgttttaaaccggggaacctttcgggacccgtaaacccgttacgggtaccgtacccgttaccggttcgggttaccaacgggaccccaacggtacccaaacccgttcttaaccggaacttcccg

SEQ ID NO: 434634 - DNA, 687 bp, Homo sapiens
  misc_feature: GZ8MTXP01AMPRX.51.81.H04.1.454.CMB.2.raw
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgcttagtggtaccagcagaagccggcaggccctgtgtggtgatgtaataaagacacgtgagacggccctgagggtactcccgtagacgacgtacttcgtccgtcggtcttcccgaggtaccgaaacgggaacctaaccgggtcaacctagttcgggaccctagtcgaggtcggacgtacccgaagggacaagggacgggaacgagggtcttacggaaccttaagtttacgttgtaacaacggtacctaaagtaacgaacccgtaaccgtaagtttccggtaaacttttacgtcgtttcccggttaaacgggtaacctcgggtaacccgtaacgttaaccgggtaccttaacccgggttcccggtacgggttacccgaccggaccccgaaacccgggtccccaaaaccccgcgttaccggttaccctaaccgttcccggtttcccccgg

SEQ ID NO: 434635 - DNA, 708 bp, Homo sapiens
  misc_feature: GZ8MTXP01ACK7U.51.81.H04.1.454.CMB.2.raw
  modified_base (221)..(221): a, c, t, g, unknown or other
  modified_base (291)..(291): a, c, t, g, unknown or other
  modified_base (329)..(329): a, c, t, g, unknown or other
  modified_base (331)..(331): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcgactctctgcacaggctctgaggcctcctatgagctgacacagccaccctcggtgtcagtcgtccccaggacagacggccaggatcacctgctcgtgganatgctattcgacctaaaccgatatgtactttagttggtaccagacagaagccggcacggccctgtgttgngatagtaataaagacagtgagacgcctgagggctccgngngcgtattcgtcgtcggcgtaccgtaacggtcgaaacggggaaccgtaaccgggtacacgtaagtttcgaccgagtccgtaagggtacgggaacgtacccggaggaccggaagggtaagggaaccggaggtccgttaagggtaacctttaaagttaagtttacggtaaacctaaaggttaaccaaacgtacgaaacctaaccgtaagtttacggttaacctttagttacgttccgtaacggtaacgttcgaaccgaaccgttaaacggtccgaacccggtttaccgttcggggttacccaccggttaaccccggtaaacccggtaccccaaaccccgtacgttaccggttaacccttcccgttcccgttttcccccgg

SEQ ID NO: 434636 - DNA, 552 bp, Homo sapiens
  misc_feature: GZ8MTXP01A9205.51.81.H04.1.454.CMB.2.raw
  modified_base (512)..(512): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttatggtaccagcagaacgccggccaggtccctgtggttggtgatgtaataaagacactggagacggccctagaggggtactcccgtgagcgtattctcgtggctcgaggtcaaagggacaacggcactagttggcctaagtcgaggtcggacgtccgagggcaggagggacgagggtctaggtattattagttgtacaatacaacaacgactacctagttcggtattatcgtcgttacgaactggaacacgaggtccacggtcgtgggcncgaccaacgccctaacccgctcgttctaaccttcgtcccg

SEQ ID NO: 434637 - DNA, 609 bp, Homo sapiens
  misc_feature: GZ8MTXP01BI9AM.51.81.H04.1.454.CMB.2.raw
  modified_base (290)..(290): a, c, t, g, unknown or other
  modified_base (317)..(317): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctcgtggagatgctattcgaccaaacgatatgcttatggtaccagcagaagccggcacggccctgtgtgtgatgtaanaaagacatgagacgcctgagggctccngacgcgtatctctgctcgaggtcgaagggacaacggtcacgtagttcggacagtcgaagtggacgtaccgaggacgaggacggacggagtcgtagtaacttattagttagtaacctaatacgaaacagaacctaacgttagttacggttaactttagttagttcgtttaacggaactcggtaacgtaaccgaaggggttccaaccggttccgtacggggttaccaccggacccgaaaccgggacccctaaaacccggtcgtaccgttacctaacctttcccggtttcccccg

SEQ ID NO: 434638 - DNA, 625 bp, Homo sapiens
  misc_feature: GZ8MTXP01EZURN.51.81.H04.1.454.CMB.2.raw
  modified_base (222)..(222): a, c, t, g, unknown or other
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttattggtacagacagaacgccggcacggccctgtgtggtgatagtaataagacactagagacggcccctagagggactcccgtggacgcgtacttcgtcgtcggtcctacccgaagggttccgaacggggaacctaaacgggttccaacgtacgtttcgggaccctaagtcgaggttgggacgtccgaggcgaaggacgggacgaggtcctagtaccttaattacttagggtactaatacgaacagaacctacgtagttacggttacttatcgttaccgtcggaaactcggaccgaaccgttaacgggtcctaacccggttcgttcggttaccgaacgggacccaacgggaccccaacccgacgttccgttcttaacccg

SEQ ID NO: 434639 - DNA, 725 bp, Homo sapiens
  misc_feature: GZ8MTXP01AS0RS.51.81.H04.1.454.CMB.2.raw
  modified_base (222)..(222): a, c, t, g, unknown or other
tcagcgatcgtatacacgaccggtgctcgatttagtagtgtagattcgcggggggtgggtccaggaggcagaactctgggtgtctcaccatggcctggatccctctacttctcccctcctcactctctgcacaggctctgacggcctcctatgagctgacacacgcccaccgtcggtgtcagtcgtcccaggacaggacggcaggatcacctgctcgtgganatgactatacgaaccaaacgatagtcgtacttagtggaccagcgaaggaacggccgggaccgacggtccccgtggttggttggtagtacgtagtaaagtaaacgacgtacgtaggaacggtacggtacccgtacggacgggtacctccggtagacgtcgtacttcgtcgtacggtcgtacggtacggacgaaacgggaaccgtaacggtactaacgttacgtcggacctacgtacggtacggtaggtacgacggacggacgagggacgggaacggacggtacgtacgtaacgttattacgttagttaacaaacttaacgaaacgtaaccaacgtaaccgtttaggttaccgttaagtttacgttcgttaccggttacggtaccgtacggaaccgtaaccggttacggtccgttaccgggttaccgcgggttaacccgccgggttacccgaaccccggtaccctaacctccggtccttaccggtaaccttccggttaacccccg

SEQ ID NO: 434640 - DNA, 784 bp, Homo sapiens
  misc_feature: GZ8MTXP01C36K9.51.81.H04.1.454.CMB.2.raw
  modified_base (279)..(279): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctctcactctctgcacaggctctgaggcctcctatgagctgacacagccacctcggtgtcagtgtccccaggacagacggccaggatcacctgctctggagatgcattcgaccaaacgatatgcttatggtaccagcagaagccggcaggccctgtgttgngatgtaataaagcactggacgacggccctacgagggtactccccgtaggacgccgtactttccgtcgttggaccctccgaaacgggttaccaaggggggtaaacctaaaccggggttacaaaccgtacgtttacggggacccctaagtaccgtaaggttacggggaacgttaccggaacgggtacccggaaagggttaacggggtaaaccgggaacgggtacccgttaagggtaaacctttaaacgttttacgtttaaggggtttaaccaaaacgtttaaccgtaaaaccctaggaaaccctaacccgttaagttttaacggggttaaaccctttaagttcggttacccgttaacgggtaaaacctttcggaaaccggtaaacccgttaaacgggttacccgtacccgggttaacccggttcggggttacccaaacccgggttacccccgaaacggggttacccccaaaacccccggttcttaacccggttcccgttaaaccccg

SEQ ID NO: 434641 - DNA, 720 bp, Homo sapiens
  misc_feature: GZ8MTXP01API3O.51.81.H04.1.454.CMB.2.raw
  modified_base (222)..(222): a, c, t, g, unknown or other
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgganatgcattgaccaaacgntatgcttattggtaccagcagaagccggcaggcccctgtgttggtgatgtaataaagactactggagacggcccctgacggggtactcccgtaggagccgtactttcctcgtcggggtcccttacccgaaaggggttaccgaagggggtaaaccaaaccggggttcaaacgtaagttcgggaccctaagtcgtaaggtcgggaacgtcccgaagggccaagggagggtacggaagggcctaggtaacttaattagtttacgggtactaaaacttaccaaaactaaacggaaccctaaaccgtagttttacggttaaacctttagtacgtttaccgttaacgggtaacttcggacccgtaaacccgttaaacggggttccccgtaaacccgggttcccggtttacgggggttacctaaacccggccccgaaaaccgggtacccccgaaacccccttaccgttcggttaaccccgttaacccg

SEQ ID NO: 434642 - DNA, 712 bp, Homo sapiens
  misc_feature: GZ8MTXP01BF90U.51.81.H04.1.454.CMB.2.raw
  modified_base (222)..(222): a, c, t, g, unknown or other
  modified_base (239)..(239): a, c, t, g, unknown or other
  modified_base (282)..(282): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgganatgcattgaccaaacgntatgcttatgaccagcagaacgccggcaggcccgtgtgttggngatgtataaagacatgagacgccctagagggactcccgtgacgtcgtactttcctcgtcgggtcctcccggtaaagggtaccgaaggggaacctaaaccggggttcaacgtaagttcgggaccctagtacgtaggtacgggacgtcccggaagggaccgaagggaacggggaccgtaaggggcttacggtaaactttaaggtttaatttacgggtaacctaaagtaccgtaaaacacgtaaaccctaccgttaaggtttacggttaactttacgttacggttccgtttacgggaaacccgttggacccgtaaacccggttaaacggttccctaacccgggttaccccgttgggggacccctaaccggtacccccggaaaccgggtaacccccaaaccccccttaggttcccgttaacccgttaacccccg

SEQ ID NO: 434643 - DNA, 708 bp, Homo sapiens
  misc_feature: GZ8MTXP01AMCF8.51.81.H04.1.454.CMB.2.raw
  modified_base (202)..(202): a, c, t, g, unknown or other
  modified_base (217)..(217): a, c, t, g, unknown or other
  modified_base (233)..(233): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccacctcggtgtcagtcgtccccaggacagacggccaggntcacctgctctggantgcattgaccaaacgntatgtcttatggtaccagcgagaacggccgggccacggcccctggttcgttggtgtatacgtaataaagacacgtgagacggccctagacgggtactcccgtagacgcgtattcgtccgtcggctaccggaggtacgaaagggaccctaacgggtcaacgtacgttcgggaccctaatcggtaagtacgggacgtacccggagggaccgaagggtacgggaacggtacgggtctaacggtatttaaagtttacgttacggttaacaacgttaaccaaacggttaaccgaaccctaaccgtagttacggttaacctttaagttccggttaccgttacgggaaaccgtttcgggaaccctaacggttaaaccgggtcccgttaccccgggttccggttacgggttaccccgacgacccccggtaaacgggccccctaaacccgtacgtccgttacccttccgttcccgtttccccgg

SEQ ID NO: 434644 - DNA, 769 bp, Homo sapiens
  misc_feature: GZ8MTXP01EVML9.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtaccagcagagccggcacggccctgtgtggtgatgtaataaagacacgtagagacggccctacgacgggactcccgtgacgcgtattcgtccgtcggctccgaggtaccgaaacggggaaaccgtaacgggttccaaacgtacgtttacgggacccctaagtccgtaaagggttcgggaacgttacccgaagggccgaaagggaacggggtaaccgggaggtaccgtaggtaaccttaaagtttaagtttacgtaacctaaacgttaacaaaacgtaaacggaaacctaaacccgttaagtttacggggtttaaaccttttaagttacgtttacccgtttaaccgggtaaaccgtttcgggaaccgtaaaccccgttaaaggggttaccccgttaaaccccgggtttcccggttacgggggttaaccccgaccggaaacccccggtaaacccgggtaacccccaaaaccccccgttaccgttaccgggttacccgttaaccctttcccggttttaaccccccgg

SEQ ID NO: 434645 - DNA, 636 bp, Homo sapiens
  misc_feature: GZ8MTXP01CBAR1.51.81.H04.1.454.CMB.2.raw
  modified_base (218)..(218): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgatatgcttatggtaccagcagaagccggcaggccctgtgttggtgatgtaataaagacacgtgagacggccctcgagggactcccgtgagcgtattctcgtggctccgaggtcgaaagggaaccaacggtcaacgagttcggacctatcgaggtcggacgtccgagggcaggacgggacgaggctagacttagttattagtacaacgtacaaacgtaacgaacctaaccttagtttacgggttaactttaacgttcggttaccgttaccggtaaaccttcggaacccgtaaccgttaaacgggtcccttaacccggttaccgtcggggttacccgaccgttaccccgaacgggccccctaaaccccgtcgtaccggttaccctaacccttcccgtttccccg

SEQ ID NO: 434646 - DNA, 615 bp, Homo sapiens
  misc_feature: GZ8MTXP01DNCR7.51.81.H04.1.454.CMB.2.raw
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgtcttatggtacagcagaacgccggccacggccctgtgttggtgatgtaaataaagacactgagacggccctcgagggactcccgtggacgcgtattctccgtcggctccgaggtacgaaagggaacctaacggtcaacgtagttcggacccatcgaggtggacgtcgaggcgagagggacgaggcctagtactagttatagttacaaactacgaaactaacgacctaacctagtttacggttaactttaacgttcgttccgtttaacggaacgtcgtaacccgaaaccgttacggtaccttacccggtccgttcggggaccacggaccccgaaaccggaccccaaccctacgtcgccttaaccttcgttcccccg

SEQ ID NO: 434647 - DNA, 547 bp, Homo sapiens
  misc_feature: GZ8MTXP01CVIIM.51.81.H04.1.454.CMB.2.raw
  modified_base (240)..(240): a, c, t, g, unknown or other
  modified_base (320)..(320): a, c, t, g, unknown or other
  modified_base (522)..(522): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctggagatgctattgaccaaacgtntatgtcttattggtaccagcagagccggcaggcccctgtgttggtgatgtaataaagcactgagacggccctcgagggcnccctgagcgtattctcctggctcgaggtcgaaagggacaacgggtcaacattggcctatcagtggagtcgaggcgaggaggacgaggctagacttattattgtacaatcaacagaaccaccgtattcggtattagtgttcgtacggactgcgaacaaggtcccacgtccgtcggttcgacgcccgaacggaccccaaccccnctcgttactaaccttcgttaacccg

SEQ ID NO: 434648 - DNA, 624 bp, Homo sapiens
  misc_feature: GZ8MTXP01EPW0A.51.81.H04.1.454.CMB.2.raw
  modified_base (281)..(281): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtatcagtcgtccccaggacagacggccaggatcacctgctctggagatgctattcgaccaaacgatatgtcttatggtaccagcagaacgccggcagccctgtgtggnatgtaaataaagacacgtgagacggccctgacgggactccgtagacgtcgtattcctccgtcggctacgaggtcgaaacgggaacaacgggtcaactagttcggacctagtcgagggtggacgtccgaggcaaggtacgggacgaggtcgtagtaacttatttagttacgtacaaacgttacaaacgtcgaacctacctagtttacggtactttaacgtgttaccgtacggtaactcggaacgtaaccgaaggtcccttaccggtccgttggggaccaccggaacccgaacggcccctaaaaccccgtgtaccggttcctaaccccgtttcgttaaccccccg

SEQ ID NO: 434649 - DNA, 735 bp, Homo sapiens
  misc_feature: GZ8MTXP01DDD17.51.81.H04.1.454.CMB.2.raw
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctctcactctctgcacaggctctgaggcctcctatgagctgacacagcccaccctcggtgtcagtcgtccccaggacagacggccaggatcacctgctctggagatgcattgaccaaacgntatgcttatggtaccagcagaacgccggccacggcccctgtgttggtgatgtaaataaagacacgtggagacggccctcgacgggtactcccgtgacgtcgtatttccgtccgtcggtcctaccgtacgggtacgaaacggggaaccctaacgggtccaaacgtacgttacggaccctagtcgaagggtggtacgtacccggaagggacgaagggaagggacggagggtcctaggtaacttatttagttacgtacaaagttaccaaacgtaacgtaacctaacccgttaagtttacgggttaactttaaacgttcggttaaccgtttacggtaaaccgttcgggaaccccgtaaacccgggttaacggttacccgaaaccccggtttcccgggtacggggttaccccgaaccggttaacccccggaaacccgggaaccccctaaaccccctaaccgttacggttaaccccttaaccccgttcccgttttaaccccccgg

SEQ ID NO: 434650 - DNA, 580 bp, Homo sapiens
  misc_feature: GZ8MTXP01BTD9B.51.81.H04.1.454.CMB.2.raw
  modified_base (240)..(240): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgcttatggtacagcagaagccggcacggccctgtgtggtgatgtataaagcactgacgacggccctgagggactcccgtgagcgtacttctctggcctccgaagtcgaagggacaacggtcactagttcggcaatcagtggagtccgaggcaaggaggacgagggctagacttattagttacggtacaaatacaaacagaaccaccgtagtttacggttacttagttcgtcgttacggaaactcggacgaaacccgaaggtcccgtaacccgttccggttcgggttaccaaccgaccccgaacggccccaaaccccgttactccgttaactaacccg

SEQ ID NO: 434651 - DNA, 630 bp, Homo sapiens
  misc_feature: GZ8MTXP01DXG7I.51.81.H04.1.454.CMB.2.raw
  modified_base (240)..(240): a, c, t, g, unknown or other
  modified_base (496)..(496): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctggagatgctattcgaccaaacgntatgtacttatcggtacagcaagaacgccggaccacggtcccgtgtggtgtgatagtaataaagcagtgagtacggcccctagagggtactcccgtagacgtacgtacttcctcgtcggccctacccggaagggttaccgaacggggaccgtaaaccgggtcctaacgtacgttcgggacctaagtcgtaggtaggacgcgaggacgaaggacggacgaggactagtaattattagttcgtaactaatacaacganacctacgtagttaggttacttagttcgttacgtcggtaacgtcgacgtaaaccgttacggtcctacccggttacggttcgggaccaaccgtacccgaaccgaccccgtaacccacgttccgttccgttaacccg

SEQ ID NO: 434652 - DNA, 728 bp, Homo sapiens
  misc_feature: GZ8MTXP01A89E4.51.81.H04.1.454.CMB.2.raw
  modified_base (217)..(217): a, c, t, g, unknown or other
  modified_base (236)..(236): a, c, t, g, unknown or other
  modified_base (682)..(682): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcactgctctgganatgcattcgaccaaacgtntatgactttagtgtaccagcagacgccggcacggtccctgtgttggtgtatgtaataaagcagtgacgaggcccctagacgggactcccgtagacgtacgtacttctaccggtcggtccttaccggaacgggttaccggaaaacgggggtaaccctaaccgggttaccgtaaacccgttaaggttttaccgggaccccgtaaaggttcccgaaggggttacgggtaaccgggttacccgaacgggggaccgaaacggggaacggggtaaacccggggaaggggttaccgttaaccggttaacggtttaaatttaaacggtttactaaaccgtaaacttaacgaaaacgacgtaaacctaacccgttagtttacggttaaccgttagttacgttacgttacgaacgtcggaacgaccgttaagggtcccaccgttcgtcgggttacnccgaccgaaaccgcccaacccgtctacgttctaaccgttctccccg

SEQ ID NO: 434653 - DNA, 577 bp, Homo sapiens
  misc_feature: GZ8MTXP01EMK7Z.51.81.H04.1.454.CMB.2.raw
  modified_base (217)..(217): a, c, t, g, unknown or other
  modified_base (235)..(235): a, c, t, g, unknown or other
  modified_base (271)..(271): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctctcactctctgcacaggctctgaggcctcctatgagctgacacagccaccctggtgtcagtcgtccccaggacagacggccaggatcacctgctctgganatgcattcgaccaaacgntatgcttatgtacagcagagcggcagcctgtgtgtnatgaataaagacacgtgagacgccctagagggactccgtgacgcgtattctcgtcggctaccgaggtcgaaagggacaacggtcaactagttcggacctatcgaggtaggagacgagacgaaggacggaacgtaggtactagtaacttattagttagtaacaagtaacaaacgaacgaactaactagttacgttagttagttacgttacgtacgtacgtacgtaacgtaacgttacgtacgttaccgtacgtacggttacgacgaccgaaccgacccaaccctacctacgttactccgttcgtccg

SEQ ID NO: 434654 - DNA, 663 bp, Homo sapiens
  misc_feature: GZ8MTXP01BPKIL.51.81.H04.1.454.CMB.2.raw
  modified_base (234)..(234): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggcaggatcacctgctctggagatgcattgaccaaaacgntatgcttatggacagcagaagccggcaggccctgtgttggtgatgaaataaagacactgagaggcccctagagggactccctgagcgtattcgcctggctccgaggtccaaagggaaccaacggtcaaacgtaattcggaccctaaagtcagtaggtagtaccgaggacgaaggaagggaacggaaacgggtacgtacgtaacgttaaagttaagttacgttaactaaacgtaactaaaccgaaacgtaaacgtaaacctaacgttacggttaacgtttaacgttacgttacgttacggtaaccgtacggtaaccggaaccgaaacggtaccgttacccggtaccggtacgggttacgttaccgacccggaaacccgaaccccgaaaccccgtaacccgtaccgttaccgtaaccgttccgttaacccg

SEQ ID NO: 434655 - DNA, 563 bp, Homo sapiens
  misc_feature: GZ8MTXP01BORHB.51.81.H04.1.454.CMB.2.raw
  modified_base (239)..(239): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaacgntatgcttatgtaccagcagagccggcacggccctgtgtgtgatagataaagacatagagacggccctagagggactccgtgagcgtattctccgtggctccgaggtcgaaagggaccaacggtcactagttcggccagtcaggtgagtccacggcaggtaggacggaggctaggacttagttatgtacaatcaaacagaccactagttacggttattattcgtacttacggactcggaacgaccgttaaggtccacccggtcgtacgggttaccgacgaccccgaacgacccaacccgtactcgttacctaaccttcgttcccg

SEQ ID NO: 434656 - DNA, 596 bp, Homo sapiens
  misc_feature: GZ8MTXP01EI4BR.51.81.H04.1.454.CMB.2.raw
  modified_base (175)..(175): a, c, t, g, unknown or other
  modified_base (219)..(219): a, c, t, g, unknown or other
  modified_base (236)..(236): a, c, t, g, unknown or other
  modified_base (275)..(275): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggatcacctgctctgganatgcattgaccaaacgntatgtcttattgtacagcagagcggcagccctgtgtgtnatgataaagacatgagagcctacgaggctccgtgacgcgattctcctcggctccgaggtcgaacgggacgaacggtcactagttacggccatcgagttggagtaccgagggacagaagggaccggagtacgtagaacgttattagttagtacaaacgttcaaactaacgactaacgagttaggttacttatcgttcttacggaaccttggaaccgtaacgttaacggtcccgaccggttaccgtacggggttaccaccggaccccgaacgggacccccaaacccctactccgttacctaaccgtttcccgtttaaccccgg

SEQ ID NO: 434657 - DNA, 664 bp, Homo sapiens
  misc_feature: GZ8MTXP01AV7CX.51.81.H04.1.454.CMB.2.raw
  modified_base (239)..(239): a, c, t, g, unknown or other
  modified_base (291)..(291): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaacgntatgcttattggtaccagcagaacgccggcaggccctgtgtggtgatgtaanaagacacgtgagacggccctgagggtactcccgtgacgcgtacttctcgtcggctcccgaaggttcgaagggacaacgggtacacgtattcgggacctagtcgaaggttgggacgtcccgaagggaccgaaagggacgggaaccggagggtaccgttagggtaaacctttaagtttaagtttcggggtaacctaaaagttaccgaaaaccaaaggtaaccctaaccgttaaagtttacgggttaacctttagttacggttaccgtttaaccggggaaacttcggaaccggtaaccgttaaacgggtccctaaccggttccgttcggggccaacgacccgaacgaccccgacccttacgtcgttcccgtaaccg

SEQ ID NO: 434658 - DNA, 681 bp, Homo sapiens
  misc_feature: GZ8MTXP01DJ5H0.51.81.H04.1.454.CMB.2.raw
  modified_base (304)..(304): a, c, t, g, unknown or other
  modified_base (443)..(443): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctcgtggagatgctattcgaccaaaaccgtattatgtactttagttcggtaccagcaaggacggccgggccacggccctgtgtgtgatgaanaaagacagtggagacgccgtcgagggactccgagacgtcgtattctccgtcggctccgaggtcggaaacgggaactaacggtcacgtagttcggaccctagtcgaggtacgacgtccgagggacgagggacgggaacgngggtactaggtacttaagttattacgtaacctaattaccgaaacgtaacgaacctaccttagtttcggttaacttagttacgttacgtttaccggaacgttcggaaccgtaaccgttaagggttcccttaaccgggttacccggtacgggttaccgacccggaaaccccggaaacccggaaccccctaaaccccgtaccgttacggttaccctaacccgtttcccgtttaaccccccg

SEQ ID NO: 434659 - DNA, 775 bp, Homo sapiens
  misc_feature: GZ8MTXP01AOCP6.51.81.H04.1.454.CMB.2.raw
  modified_base (213)..(213): a, c, t, g, unknown or other
  modified_base (218)..(218): a, c, t, g, unknown or other
  modified_base (238)..(238): a, c, t, g, unknown or other
  modified_base (242)..(242): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacacgccaccctggtgtcagtcgtccccaggacagacggccaggatcactgctntgganatgctattcgaccaaacgtntatntcgggtttatcggtaccagcaaggacggcccggccacggtccctggttgttggtagtatagtaaataaacgacagtgaggacggcccgtagacgggtacctccgtaggacgtcgtattccgtccgtcggcctccggaggtaccggaaacgggtaaccgtaacggtcaacgtacggttcggaccctagtcggtagggtcggacgtacccggagggaccgaaggggacggaacgggtggtaccgttaggtaaacctttagtttaacgttacgtaaccgtaaacttacgaaaaccgtaaccggtaaacccttaaccgttaggtttaccgtttaaacgtttacggttccggttaaccgggttttaaccggaaacccgtttcgggaaaccccggtaaacccgggtttaacccgggttccccgttaaccccggggttacccgggttacggggttaaccccgacccgggttaaccccggtaaacccggaccccctaacccgtacgtccgttaccctaacccgtttcccgtttaacccccg

SEQ ID NO: 434660 - DNA, 598 bp, Homo sapiens
  misc_feature: GZ8MTXP01BAL6J.51.81.H04.1.454.CMB.2.raw
  modified_base (222)..(222): a, c, t, g, unknown or other
  modified_base (287)..(287): a, c, t, g, unknown or other
  modified_base (488)..(488): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacacgccaccctcggtgtcagtcgtccccaggacagacgccaggatcacctgctctgganatgctattcgacccaaaacgtatatgcttattggtacagcagaacgccggcacgccctgtgtgtnatgtaataaagcacgtgagacggccctaggagggacttcccgtggagtcgactttccgcgttcggcccttaccggaaacgggtaccgaacggggtaaacgtaacccgggtacaacgtaagttcgggacctaagttcgaggtggacgtcgaggacgaaggaggacgagcgagtaactaatttagtcggtacaatacaacganacactagttacgtacttagtcgttcgtcgaacgtcgcctaacgaacgttcgaccgttccgttcgggacaaccggaccccgaacgccccctaaacccgctccgttctcccg

SEQ ID NO: 434661 - DNA, 673 bp, Homo sapiens
  misc_feature: GZ8MTXP01AMKYK.51.81.H04.1.454.CMB.2.raw
  modified_base (239)..(239): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaacgnttatgtcttagttggtaccagcaagaacggccgggccacggccccgtgtcgttggtgatgtaataaagacagtagagacgccctagagggtactccgtgacgctattcctcgtggctcgaggtcgaaagggacctaacgggtcaacgtagttcgggaccctagtcacggttgacggtacgagggactaacggagggaacgaggtctaggtacttatttagtacgttacaaacgttacaaacgtacgtaacctaccgtaagtttaggttaacctttaatccgttacgttacggggtaaacttcgggaaccgtaaaccggttaaccgggtccttaccccgggttcgtacgggttaccgaccgggaacccccgtaacggggaccccctaacccctaacgggttcccgttaccgtaacccgtttcccgtttccccccg

SEQ ID NO: 434662 - DNA, 615 bp, Homo sapiens
  misc_feature: GZ8MTXP01EO5TC.51.81.H04.1.454.CMB.2.raw
  modified_base (245)..(245): a, c, t, g, unknown or other
  modified_base (290)..(290): a, c, t, g, unknown or other
  modified_base (453)..(453): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatccacctgctcgtggagatgctattcgaccaaacgntatgtcttagtcggtacagcagacgccggcacggccctgtggtgngatgtaataagacagtgagacgccctagacgggactcccgagacgcgtacttccgtcgtcgggtacctccggtaaacgggtacgaacggggacctaaacgggtcaacgtagttcgggactacgtcgaggtaggacgtaccgaaggcgaaagggacggaacggngggtctaggtaactttagttaattcggggtactaaatacgaacaagtacctaacttagttacggttactagtcgttacgtacgaactgaccgaaccgttagtccgtaccttcgttcggttacaacccgaccctaacggacccctaccgacgtcgttctcccg

SEQ ID NO: 434663 - DNA, 595 bp, Homo sapiens
  misc_feature: GZ8MTXP01BUVRF.51.81.H04.1.454.CMB.2.raw
  modified_base (291)..(291): a, c, t, g, unknown or other
  modified_base (385)..(385): a, c, t, g, unknown or other
  modified_base (432)..(432): a, c, t, g, unknown or other
  modified_base (443)..(443): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgactattcgaccaaaccgtatatgtactttagtggtaccagcaggaacgccggcacggccctgtgttggngtatagtaataagacacgtgacgacgccctagacgggactccgtagacgtcgtacttctccgtggctacgaggtacgaaacgggactaacggtnaacgtagttcggacagtacgagtggacgtccgaggcgaggaggacgngctagattatntagacaagtacaacgagactactagttacggtatttgtcgttacttacggaacgtgaaccgtaaccgacggtcccaccggttccggtaggttaccgccggaccccaacggccccaaacccgtgtaccttccgtaaccttcccgtttcccccg

SEQ ID NO: 434664 - DNA, 736 bp, Homo sapiens
  misc_feature: GZ8MTXP01A7ACJ.51.81.H04.1.454.CMB.2.raw
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtccagtgtccccaggacagacggccaggatcacctgctctggagatgcattgccaaacgntatgcttattggtaccagcagaacgccgggccaggcccctgtgttggtgatgtaataaagcactgagaggccctgagggactcccgtgagcgtacttccgtcgtggcctccgaagggttcgaaggggaccaaacgggttccaactaagtttcgggaccctagtaccgtaggtggacgtcccgagggccgaaggacgggaaccgagggcctacggtaacgttaactttaagttaggggtacccgtaaaagtttcccgaaaacctaaggaaacccgtaaccccttaaaggtttaccccggggtttaaattttaaacggttcggtttccccgttttaacggggaaacccgtttcgaacccgggtaacccgttaaaaccggggttccctaaacccccgggtttccccggttcgggggttaccccaaccggggtaccccctaaaaccggggcccccctaaaaaccccgttcccgttaacggttaacccccccgttaacccgg

SEQ ID NO: 434665 - DNA, 740 bp, Homo sapiens
  misc_feature: GZ8MTXP01BVFHL.51.81.H04.1.454.CMB.2.raw
  modified_base (219)..(219): a, c, t, g, unknown or other
  modified_base (703)..(703): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggantgcattcgaccaaaccgtatatgtcttaagttcggtaccagacgacggaaggccccgggacctacggtcccctggttaggttcggtagtattacggtaaataaaggaccacgttagaacggacggtccccgttacggaacgggtacgttccccgtaggtacgtcgttagttcctcccgtcggtcctaccggtacggtaccgaaaacgggtacctaacgggtactaaccggtacgttccgggtaccctaagtacgtacgggttcggacggttaccgaacgggagtaccgggaagggaaccggtaaacgggtccttaagggtaaacctttaatttacggtttacgtaaccctaaaggtacccgtaaaaccgtaacggtaacccttaacgttaagtttacggttaactttaacgttcgttacggttacgggaaactcggaacgtaaccgttacggtccttacgtccgttacgggccttacggacccncggaccctaaccggtctgttacctcgttccgttcccg

SEQ ID NO: 434666 - DNA, 560 bp, Homo sapiens
  misc_feature: GZ8MTXP01EV11O.51.81.H04.1.454.CMB.2.raw
tcagcgatcgtatacacgaccggtgctcgatttagtagtgtagattcgcggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttatggtaccagcagaagccgggccaggcccctgtgttggtgatgtaataaagacactgagaggccctgagggatccctgagcgattctcctggctccgaggtcgaaagggacaacggtcaacattggaccatcagtggagtccgaggcagaggacgaggctgaactattaattgtacaagtacaaacgagaacacctattaggttacttagtgtcttacggaactgaacgtaaccgaaggtaccaccgtccgtacggggttaccacggaccccaaaggccccaaaccccgctcggttaccaaccgttcttaacccg

SEQ ID NO: 434667 - DNA, 620 bp, Homo sapiens
  misc_feature: GZ8MTXP01BZ4LP.51.81.H04.1.454.CMB.2.raw
  modified_base (223)..(223): a, c, t, g, unknown or other
  modified_base (241)..(241): a, c, t, g, unknown or other
  modified_base (286)..(286): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattcgaccaaacgntatgctttatggtaccagcaagaagccggcacgccctgtgtggtnatgtaataaagcacgtgagacgccctagacgggtactacccgtgacgcgtacttcctacgtggctccgaagggtcgaagggaccaacggtcactagttcggacctatcgaggtcggaacgtccgaaggacgaggagggacgtacgggctagtaacttaagtttacttggggtactaacgtaccaaacgaacgtaccaaccgttattacgggtttaacttagttcgttacctagggtaactacggcgaaaccgttacgttaccgaccggttaccgttcggggttaccaacggaccccgaaacggccccaaacccgttcgtcgttaaccgtaaccg

SEQ ID NO: 434668 - DNA, 698 bp, Homo sapiens
  misc_feature: GZ8MTXP01ALHE2.51.81.H04.1.454.CMB.2.raw
  modified_base (222)..(222): a, c, t, g, unknown or other
  modified_base (241)..(241): a, c, t, g, unknown or other
  modified_base (298)..(298): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgacccaaacgntatgtcttagttggtaccagacagaacggcccgggccacggtcccctgtggttggtnagtagtaataaagacacgtgacggacgtccctagagggacctccgtagacgtcgtacgttcctcgtcggtcctaccggaaacgggttccggaacggggtaacctaaccggggtaccaacgtacgtttcgggaccctaagtaccggaggttacggtacggtaccggagggaccgaaggggacgggtacggacgggtaccttagtaactttacgtttacgttacgtaactaaactaccaaacgacgtaaccgtaccgttagtttacggttaacttgttcgtttaccgtacggttaactccgacggtaaccgttaacggtcccgacccggtttacggccggttaaccgaacccggacccgaacccggaaccccaccggttacttccgttaaccgttaaccccg

SEQ ID NO: 434669 - DNA, 693 bp, Homo sapiens
  misc_feature: GZ8MTXP01DD7BQ.51.81.H04.1.454.CMB.2.raw
tcagcgatcgtatacacgaccggtgctcgatttagtagtgtagattcgcggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgattatgcttatggtaccagcagaagcccggcaggccctgtgttggtgatgtataaagacacgtgaggacggtccctcgagggactcccgtaggacgtcgtacttcctacgtcgggcctacccgaacgggttccgaagggggaacctaaaccgggttccaactacggtttacgggccctaatccggaaaggttcgggtacgtacccgagggaccgaaggaacggggacggaacgggcttacgggtaaccttaaagtttagttcggggtaactaaaggttaccaaacgacgtaacctacccgtaagtttcggtaaactttagttacgttcgttaccgggtaacttcggacccgtaaccggaacggtacccgttacccggttacccgggttggggttacccgaacggaaccccgaacgggtccccaaaaccccttcgtaacgttaaccttaacccg

SEQ ID NO: 434670 - DNA, 715 bp, Homo sapiens
  misc_feature: GZ8MTXP01E1ZHV.51.81.H04.1.454.CMB.2.raw
  modified_base (221)..(221): a, c, t, g, unknown or other
  modified_base (239)..(239): a, c, t, g, unknown or other
  modified_base (255)..(255): a, c, t, g, unknown or other
tcagcgatcgtatacacgaccggtgctcgatttagtagtgtagattcgcggggggtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacgccaggatcacctgctgtgganatgcattcgaccaaacgntatgtcttatggtacngcagaaggccggccacggcccctgtgttggtgatagtaataaagacactggacgacggccctcgacgggtactcccgtgacgtcgacttcctccgtcggctcccgtaggtaccgaaacgggaaccgtaaccgtcgactacgttcggacctaatcgaagggtcggacggtacccgagggtacgaacgggagggaccgggaggtccgtagtaaccttattacgtttaggtacaaacggttacccaaaccgtaagaacccgtaacccgtacgtttacgttacgtttaagttccggttaccgtttaaccgggaacccgttggtaacccggtaaacccgttaaaccgggtacccgttaccccggttccggttccgggttacccgaccggacccccgtaaacccgggacccccctaaacccccgtcttaccggttaccctaaccccgttcccgtttaaccccccgg

SEQ ID NO: 434671 - DNA, 492 bp, Homo sapiens
  misc_feature: GZ8MTXP02J3652.51.81.H04.1.454.CMB.2.raw
  modified_base (234)..(234): a, c, t, g, unknown or other
  modified_base (482)..(482): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagaggccctcagggatccctgagcgatctcctggctccaggtcagggacacggtcacattgccatcagtgagtccaggcagagacgaggctgactattatgtcaatcaacagacaccattggtacttatgtcttcggaaactgcgacaaggtcaccgtctcgggcagcccaaggccaacccactntcactcttcc

SEQ ID NO: 434672 - DNA, 493 bp, Homo sapiens
  misc_feature: GZ8MTXP02G51CY.51.81.H04.1.454.CMB.2.raw
  modified_base (234)..(234): a, c, t, g, unknown or other
  modified_base (327)..(327): a, c, t, g, unknown or other
  modified_base (422)..(422): a, c, t, g, unknown or other
  modified_base (482)..(482): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagaggccctcagggatccctgagcgattcnctgctccaggtcagggacacggtcacattgccatcagtgatcagcagagacgaggctgactattatgtcaaatcaacagacaccattggacttangtacttggaactgcgaccaaggtccaacgtcctgggtcagcccaaggcccaaaccccacncgtcactctcc

SEQ ID NO: 434673 - DNA, 491 bp, Homo sapiens
  misc_feature: GZ8MTXP02IHUBE.51.81.H04.1.454.CMB.2.raw
  modified_base (233)..(233): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtacagcagagcggcaggccctgtgtggtgatgtataaagacactgagaggccctcagggatccctgagcgattctctggctccaggtcagggacacggtcacattgccatcagtgagtccaggcagagacgaggctgactattattgtcaaatcaacagacaccattggtacttatgtcttcggaactgacgaccaaaggtcaccgtctgggtcagcccaaggcccaacccactcgtccactctccg

SEQ ID NO: 434674 - DNA, 501 bp, Homo sapiens
  misc_feature: GZ8MTXP02JC9U0.51.81.H04.1.454.CMB.2.raw
  modified_base (309)..(309): a, c, t, g, unknown or other
  modified_base (329)..(329): a, c, t, g, unknown or other
tcagcgatcgtatacacgaccggtgctcgatttagtagtgtagattcgcgggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgtggtgatgtataaagacactgagaggcccctnagggatccctgagcgattcnctggctccaggtcaggggacaacggtcacattggccatcagtggagtccaggcagaggacgaggctgactattattgtcaatcaacagacacctattggtacttatgtcttacggaactgtgaccaaggtcaccgtctgggtcaacgcccaacggccaacccactcgtacac

SEQ ID NO: 434675 - DNA, 508 bp, Homo sapiens
  misc_feature: GZ8MTXP02GLYU7.51.81.H04.1.454.CMB.2.raw
  modified_base (410)..(410): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggcaggcccctgtgttggtgatgtataaagacactgagaggccctcagggatccctgagcgattctctggctccaggtcagggacacggtcacattgccatcagtgagtccaggcaggaggacgaggctgactattattgtcaaatcaanagacaccattggtacttatgtcttcggaactgacgaccaaggtccaccgtctacgggtcacgcccgaaggcccaaaccccactcgtccacgtctaccg

SEQ ID NO: 434676 - DNA, 508 bp, Homo sapiens
  misc_feature: GZ8MTXP02I57W6.51.81.H04.1.454.CMB.2.raw
  modified_base (233)..(233): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgttggtgatgtataaagacactgagaggccctcagggatccctgagcgattctcctggctccaggtcaggggacacggtcacattggccatcagtgagtccaggcaggaggacgaggctgactagttattgtcaaatcaacagacaccattggtacttatgttcttcggaactgacgacaaggtcaccgtctcggtcacgcccaacggcccaaccccgactcgtaccactcttaccg

SEQ ID NO: 434677 - DNA, 539 bp, Homo sapiens
  misc_feature: GZ8MTXP02JJOIY.51.81.H04.1.454.CMB.2.raw
  modified_base (311)..(311): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctnagggatcccgtgagcgattctctggctcgaggtcgagggacaacggtcacattggccatcagtggagtccgaggcgagaggacgaggctagacttattattgactaatcaacagaacacctattggtaacttagtgtcttacggaacttcgacgaaccgtaaaggtccgacccgttcgtcggggtacaacggacccgaaacggcccaaacccctactcgtacctaccg

SEQ ID NO: 434678 - DNA, 498 bp, Homo sapiens
  misc_feature: GZ8MTXP02FUQ2Q.51.81.H04.1.454.CMB.2.raw
  modified_base (233)..(233): a, c, t, g, unknown or other
  modified_base (300)..(300): a, c, t, g, unknown or other
  modified_base (320)..(320): a, c, t, g, unknown or other
  modified_base (402)..(402): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtaccagcagagcggcaggccctgtgtggtgatgtataaagacactgagaggccctnagggatccctgagcgattcncctggctcaggtcagggacacggtcacattgccatcagtgagtccaggcaggagacgaggctgactattattgtcaatcaanagacaccattggtacttatgtcttacggaatgacgaccaaaggtccaacgtccgtgggtacagcccaaggcccaaccccatcgtaccactctaccg

SEQ ID NO: 434679 - DNA, 496 bp, Homo sapiens
  misc_feature: GZ8MTXP02HTR1I.51.81.H04.1.454.CMB.2.raw
  modified_base (236)..(236): a, c, t, g, unknown or other
  modified_base (343)..(343): a, c, t, g, unknown or other
  modified_base (414)..(414): a, c, t, g, unknown or other
tcagcgatcgtatacacgaccggtgctcgatttagtagtgtagattcgcggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggtgatgtataaagacactgagaggccctcagggatccctgagcgattctctggctcaggtcnggggacaacggtcacattggccatcagtggatccaggcagaggacgaggctgactatttatgtcaatcaanagacacattgacttatgtcttcggaactgacgaccaaaggtcaccgtctggtcaaggcccaacggccaacccactcgtacac

SEQ ID NO: 434680 - DNA, 507 bp, Homo sapiens
  misc_feature: GZ8MTXP02F0YYY.51.81.H04.1.454.CMB.2.raw
  modified_base (238)..(238): a, c, t, g, unknown or other
  modified_base (475)..(475): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggactcccgtgagcgattctctggctccgaggtcaggggacaacggtcacagttcggccatcagtggagtcaggcagaggacgaggctagactattattgtacaatcaaacagaacactattggtacttatgtctacggaactgcgacaaggtcaccgtcnggtcaagcccaaggcccaacccactcgtctac

SEQ ID NO: 434681 - DNA, 509 bp, Homo sapiens
  misc_feature: GZ8MTXP02HP06P.51.81.H04.1.454.CMB.2.raw
  modified_base (428)..(428): a, c, t, g, unknown or other
  modified_base (495)..(495): a, c, t, g, unknown or other
  modified_base (497)..(497): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagacggccctgagggactccctgagcgtattctcctggctccgaggtcagggacacggtcacattcggccatcaggtggagtcccgaggcaggaggacgaggctagacttattattgtacaatacaanagacactattgtacttatgtacttcggaatgacgacaggtcacgtctcggcacgccaaggccaaccncncgtcactcgtcc

SEQ ID NO: 434682 - DNA, 514 bp, Homo sapiens
  misc_feature: GZ8MTXP02F2S3E.51.81.H04.1.454.CMB.2.raw
  modified_base (235)..(235): a, c, t, g, unknown or other
  modified_base (307)..(307): a, c, t, g, unknown or other
  modified_base (411)..(411): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtgttggtgatgtataaagacactgagaggccctnagggatccctgagcgattctcctggctcaggtcagggacacgggtcacagttgccaatcagtgatccaggcaggagacgaggctgactatattgtcaaatcaanagaacaccaattggtacttaatgtcttacggaactgacgaccaaaggtccaaccgtctcggggtacacgacccaaggcccaacccgactcgtacactctcccg

SEQ ID NO: 434683 - DNA, 510 bp, Homo sapiens
  misc_feature: GZ8MTXP02FJ97X.51.81.H04.1.454.CMB.2.raw
  modified_base (323)..(323): a, c, t, g, unknown or other
tcagcgatcgtatacacgaccggtgctcgatttagtagtgtagattcgcggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagaggccctcaggggatcccngagcgattctctggctcaggtcagggacaacggtcacattggccatcagtggagtcaggcagaggacgaggctagactattatgtacaatcaaacagacacattggtacttatgtcttacggaacttgacgaccaaggtcaccgtcctggggtaccaagcccaaaggcccaaccccactcgtacacc

SEQ ID NO: 434684 - DNA, 543 bp, Homo sapiens
  misc_feature: GZ8MTXP02F4FB5.51.81.H04.1.454.CMB.2.raw
  modified_base (279)..(279): a, c, t, g, unknown or other
  modified_base (342)..(342): a, c, t, g, unknown or other
  modified_base (416)..(416): a, c, t, g, unknown or other
tcagcgatcgtatacacgaccggtgctcgatttagtagtgtagattcgcgggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgatatgcttatggtaccagcagagccggcaggcccctgtgttggngatgtataaagacactgagaggccctgagggactccctgagcgacttctctggctccaggtcnggggacaacggtcacattggccatcagtggagtccgaggcagagacgaggctagactattatgtacaagtcaanagacacctattggtaacttagtcgtcgtttacggaacttggacgaacctaacggtaccaaccggttccgtcgggtaccaacggaccccaaagggcccccaaaaccccgtacgttcgtaccgtacccg

SEQ ID NO: 434685 - DNA, 500 bp, Homo sapiens
  misc_feature: GZ8MTXP02GYKDO.51.81.H04.1.454.CMB.2.raw
  modified_base (235)..(235): a, c, t, g, unknown or other
  modified_base (382)..(382): a, c, t, g, unknown or other
  modified_base (486)..(486): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgtggtgatgtataaagacactgagaggccctcgaggggactccctgagcgattctctggctccaggtcagggacacgggtcacattggccatcagtgagtccagcaggngacgaggctgactatattgtcaatcaacagacacattggtacttatgtcttcggaactgacgacaaggtcaccgtctgggtcacgcccaaaggcccaaaccccnctcgtacactctcg

SEQ ID NO: 434686 - DNA, 596 bp, Homo sapiens
  misc_feature: GZ8MTXP02I84N6.51.81.H04.1.454.CMB.2.raw
  modified_base (284)..(284): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggcccctgtgttggngatgtataaagacactgagaggccctgagggtactcccctgacgcgtacttctcgtggcctccgaggttcaggggacaacgggtcacagttcggaccatcgaggttggacgtccgaggcaggacggacgagggctgaacttattattgtacaatacaaacaagaccaaccgtagttacggtaactttagtgttcgtttacgaaacgtgaccgtaaccgaaaagggttcctaaacccggttccgtacggggtaccaaccggtaccccgaaaacgggacccccaaaaccccctacgttccggtaccctaacccg

SEQ ID NO: 434687 - DNA, 504 bp, Homo sapiens
  misc_feature: GZ8MTXP02GPEHB.51.81.H04.1.454.CMB.2.raw
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtataaagacactgagaggcctcagggatccctgagcgattctctggctcaggtcagggacacggtcacattggccatcagtggagtccaggcagagacgaggctgactatattgcaatcaacagacaccattggtacttatcgtcttcggaacttgacgactaaggtcaccggtctcgggtcacgcccaaggcccaacccgactcgtaccactcgttaccg

SEQ ID NO: 434688 - DNA, 492 bp, Homo sapiens
  misc_feature: GZ8MTXP02FOQD6.51.81.H04.1.454.CMB.2.raw
  modified_base (409)..(409): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtataaagacactgagaggccctcagggatccctgagcgattctcctggctccaggtcagggacacggtcacattgccatcagtgagtccaggcagagacgaggctgactattattgtcaaatcaanagacaccattggtacttatgtcttggaactgcgacaaggtcaccgtctgggtcagcccaaggccaacccactcgtcactctcg

SEQ ID NO: 434689 - DNA, 494 bp, Homo sapiens
  misc_feature: GZ8MTXP02GI3F0.51.81.H04.1.454.CMB.2.raw
  modified_base (234)..(234): a, c, t, g, unknown or other
  modified_base (389)..(389): a, c, t, g, unknown or other
  modified_base (409)..(409): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtgttggtgatgtataaagacactgagaggccctcagggatccctgagcgattctctggctcaggtcaggacacggtcacattggccatcagtggagtcccaggcagaggacgaggcngactattattgtcaatcaanagacaccattggtacttatgtcttcgaactgacgacaagtcacgtctgggtcagcccaaggcccaacccgactcgtcactctccg

SEQ ID NO: 434690 - DNA, 509 bp, Homo sapiens
  misc_feature: GZ8MTXP02JVZAJ.51.81.H04.1.454.CMB.2.raw
  modified_base (329)..(329): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattcnctggctccaggtcagggacacggtcacattgcatcagtgagtccagcagagacgaggctgactagttattgtcaaatcaacagacaccattaggtacttagtgtcttcggaactgacgaccgaagtccaccgtcgtgggacacgacccaaggcccaaaccccgtctacgtcctactctcg

SEQ ID NO: 434691 - DNA, 704 bp, Homo sapiens
  misc_feature: GZ8MTXP02G5PTC.51.81.H04.1.454.CMB.2.raw
tcagcgatcgtatacacgaccggtgctcgatttagtagtgtagattcgcggggctggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtatgtagtaaagaacactacgagaggacccgtccagggaacgtcctcgtagacgtacttaccgttctcggtcgtcctacggtacgacgggacggaaccggtacgtaccgaacgttggtaccgactcgtacgtaggaggtaccgacggacgaacgagggacggaacgggacgtacgtacgttaactttaagtttagttacgtaaacttactaaaccgaaaggaaccctaaaccctactttaacgggtttacgtttaaacttagttaccgtttacggttaaaccggtacgtccggtaaaccgtaaacgggttaccggtaaaccccggttccccggttaccggggttaccggtaacccggaacccggaaacccggaaccccggaaccccctaaacccgtaccggttaccgtaccctttaccccg

SEQ ID NO: 434692 - DNA, 654 bp, Homo sapiens
  misc_feature: GZ8MTXP02JC43Q.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggccaggcccctgtgtggtgatgtaataaagcactgagacggccctgagggactcccgtgagcgattctcgtggctccgaggtcaggggacaacggtcacagttcggacctagtcgaggttgggaagtcccgaagggccgaggacggggaacggaagggcgtaggaacttaatttagttaggtacctaaataccaaacaacgaaccaaccgtaagtttacgggtaaaccttttagtacgtttaccgttacggggtaaaaccttcggaaccgaaaccccgtaaaaggggttccccgtaaaccccggttcccgttagggggtacccaaacggtaccccccgaaaagggaccccccgaaaaccccctaccgttaccggttacccgtaaccccg

SEQ ID NO: 434693 - DNA, 504 bp, Homo sapiens
  misc_feature: GZ8MTXP02IU4L6.51.81.H04.1.454.CMB.2.raw
  modified_base (328)..(328): a, c, t, g, unknown or other
  modified_base (462)..(462): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctcgagggatccctgagcgattcnctggctcaggtcagggacacgggtcacattggccatcagtggagtccaggcaggaggacgaggctgactattatgtcaatcaacagacaccattggtacttatgtcttacggaactgcgacaaggtccacgtcngggtcacgacccaaggcccaacccactcgtaccactctcccg

SEQ ID NO: 434694 - DNA, 499 bp, Homo sapiens
  misc_feature: GZ8MTXP02IUUHM.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggcaggcccctgtgtggtgatgtataaagacactgagaggccctcgagggatccctgagcgattctctggctcaggtcagggacacggtcacagttggccatcagtggagtccaggcagaggacgaggctgactattattgtcaatcaacagacaccattggtacttatgtcttacgactgcgacaaggtcaccgtcgtggtcagcccaaggccccaacccgactcgtacactctccg

SEQ ID NO: 434695 - DNA, 694 bp, Homo sapiens
  misc_feature: GZ8MTXP02HQWC2.51.81.H04.1.454.CMB.2.raw
  modified_base (529)..(529): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtccgagtccgtccccgaggacaggaccggccgaaggtactccaccgtcgcttcgtaggagtatcgactagttcgaacccaaacgtatagtgtactttagttacggtaccagacgaaggaacggcccggaccgaccggtccccgtggttggttggtagtagttagtaaagtaaaacggacctaacgtaggaacggaccggtccccgtaggacgggtaccttcccggtaggacgtacgtactttccgtccggtacggtcctaccggtacgggttacgaacggggaaccgtaccgggtctaactaggttccggactacgtcgagggtggtacgacccgaggacgaggagggaacggngtcgtacgtaattattagtcgtaactaacacaacgacaccacttagttacgttacttagtcgttacgtacgtacgtcgacgtaaacgacgtaccgtaccgttcggtcgaccaccgacccgaaccggaccccaaccctacgtacgtacctccgtttcgtcccccgg

SEQ ID NO: 434696 - DNA, 519 bp, Homo sapiens
  misc_feature: GZ8MTXP02JYKMU.51.81.H04.1.454.CMB.2.raw
  modified_base (279)..(279): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagagccggcaggcccctgtgtgngatgtataaagcactgagacggccctgagggactcccgtgagcgattctctggctcgaggttcaggggacaacggtcacattcggccatcagtggacgtccgaggcagaggacgaggctagacttattattgtacaatcaactagacacctagttggtacttatcgtctacggaactgacgacgaaggtccaccgtcgtgggtacaacgcccgaacggacccaacccactcgtactaccg

SEQ ID NO: 434697 - DNA, 509 bp, Homo sapiens
  misc_feature: GZ8MTXP02IRBB7.51.81.H04.1.454.CMB.2.raw
  modified_base (233)..(233): a, c, t, g, unknown or other
  modified_base (409)..(409): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagaggcctcagggatccctgagcgattctctggctcaggtcagggacacggtcacagttggccatcagtggatccaggcagaggacgaggctgactattattgtacaatcaanagacaccattggtacttatgtcttacggaactgacgacaaaggtcaaccggtctcgggtccacgacccgaaggcccaacccactcgtacctactcttccg

SEQ ID NO: 434698 - DNA, 515 bp, Homo sapiens
  misc_feature: GZ8MTXP02IKGAX.51.81.H04.1.454.CMB.2.raw
  modified_base (237)..(237): a, c, t, g, unknown or other
  modified_base (420)..(420): a, c, t, g, unknown or other
tcagcgatcgtatacacgaccggtgctcgatttagtagtgtagattcgcggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtacagcagaagccggccagcccctgtgtggtgatgtaataaagacactgagaggccctcagggatccctgagcgattctctggctcgaggtcagggacaacggtcacagttggcctatcagtggagtccgaggcgagaggacgaggctagacttattattgtactaatcaanagactaccattaggttacttatgtacttacggaactgcgaccaaaggtccaccgtctgggtcaacgcccgaacggcccaacccactcgtactacc

SEQ ID NO: 434699 - DNA, 516 bp, Homo sapiens
  misc_feature: GZ8MTXP02I4NFS.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggccaggcccctgtgttggtgatgtataaagacactgagaggccctcgagggactccctgagcgattctctgctcaggtcaggggacaaacggtcacattcggccatcagtggagtccaggcagaggacgaggctagacttattatgtacaatcaacagacacctattggtacttatgtcttacggaactgacgaccgaaaggtccaccgtctcgggtcaacgcccaacggccccaacccactcgtactacccg

SEQ ID NO: 434700 - DNA, 520 bp, Homo sapiens
  misc_feature: GZ8MTXP02I0S36.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggactccctgagcgattctctgacctcaggtcaggggacaacggtcacattggccatcagtggagtcaggcagagagaggctgactattattgtacaatcaacagacactattgtaacttatgtacttcggaactgaccgtacgaaacggtcaccgtaccgtcgggtacaacggcccgaacggacccaacccgtactcgtactacc

SEQ ID NO: 434701 - DNA, 506 bp, Homo sapiens
  misc_feature: GZ8MTXP02GILVB.51.81.H04.1.454.CMB.2.raw
  modified_base (237)..(237): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggtgatgtataaagacactgagaggccctcagggatccctgagcgattctctggctcaggtcaggggacaacggtcacattggccatcagtggagtccaggcagaggacgaggctgactattatgtcaatcaaacagaacaccattggtacttatgtcttcggaaactgctacaaaggtcaccgtcctgggtcaacgcccaaacggccaaccccactcgtctacc

SEQ ID NO: 434702 - DNA, 513 bp, Homo sapiens
  misc_feature: GZ8MTXP02IWIUE.51.81.H04.1.454.CMB.2.raw
  modified_base (357)..(357): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggactccctgagcgattctctgctccaggtcagggacacggtcanattgccatcagtgatcaggcaggagacgaggctgactatattgtacaatcaacagacaccattggtacttatgtcttacggaactgacgaccaaaggtccaaccgttcctggggaccacgacccaaaggcccaaacccactgtccactcgtttccg

SEQ ID NO: 434703 - DNA, 496 bp, Homo sapiens
  misc_feature: GZ8MTXP02GNRQQ.51.81.H04.1.454.CMB.2.raw
  modified_base (235)..(235): a, c, t, g, unknown or other
  modified_base (277)..(277): a, c, t, g, unknown or other
  modified_base (303)..(303): a, c, t, g, unknown or other
  modified_base (412)..(412): a, c, t, g, unknown or other
  modified_base (484)..(484): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagcggcaggccctgtgtggtnatgtataaagacactgagaggccctnagggatcccgtgagcgattctctggctcgagtcagggacacggtcacattgccagtcagtgagtccgaggcagaggacgaggctagacttattattgtacaaatcgaanagacactattggtactatgtcttacggactgacgacaagtcaccgtctggacacgcccaaggcccaaacccnctcacactctcg

SEQ ID NO: 434704 - DNA, 524 bp, Homo sapiens
  misc_feature: GZ8MTXP02F5SOW.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgtggtgatgtataaagacactgagaggccctgaggggactccctgagcgacttctctggctccgaggtcaggggacaaacggtcacattggccatcagtggacgtcaggcaggaggacgagggctagacttaattattgtacaatcaaacagaccaacatttaggtaacttatgttactacggaactgaccgacgaaagtcaccgtctgggtacaacgcccaacggcccaacccgactcgtctacg

SEQ ID NO: 434705 - DNA, 542 bp, Homo sapiens
  misc_feature: GZ8MTXP02HYZR9.51.81.H04.1.454.CMB.2.raw
  modified_base (234)..(234): a, c, t, g, unknown or other
  modified_base (416)..(416): a, c, t, g, unknown or other
  modified_base (443)..(443): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaacgcggcaggccctgtgttggtgatgtaataaagcactgagaggccctcagggatccctgagcgattctctggcctcgaggtcaggggacacggtcactattggaccatcagtggagtccaggcaggaggacgaggctgactattatgtactaatacaaanagtaaccactaagtttggaactttagngtttacgttacgaacttcgacgaacctaagggtccaccggtccgtacggggtccacggaccccaaggccccaaacccgctcgtaccaccttcctacccg

SEQ ID NO: 434706 - DNA, 576 bp, Homo sapiens
  misc_feature: GZ8MTXP02JEA7I.51.81.H04.1.454.CMB.2.raw
  modified_base (234)..(234): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagagccggcaggcccctgtgtggtgatgtataaagacactgagaggccctcgaggggactcccgtgagcgattctcctggctccaggtcagggacacgggtcacgagttcggcctatcgagtggagtcccaggcagaggacgaggctagacttagttattgtacaatacaacagaccaaccagttacggtacttagtcgttacgttacggaaacttcgacgaaccgtaagggtaccgaacccggttaccgtcggggtaccaacggaccccgaaacgggaccccaaaacccccgtacgtacggtacctaaccgtactttccccgg

SEQ ID NO: 434707 - DNA, 619 bp, Homo sapiens
  misc_feature: GZ8MTXP02GPME8.51.81.H04.1.454.CMB.2.raw
  modified_base (282)..(282): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggcaggcccctgtgtggngatgtaataaagacactgagacggccctgagggactcccgtgagcgtacttctcgtggcctcgaaggttcgacggggacaaacggtcaacgtagttcggacctaatcgaaggttcggacgtcccgagggccgaaggacgggaacgagggcctagaacttaagtttattgtactaaatacaaaacagaaacctacctaagtttacggtaactttaagtcgttacgttacggaaaacttcgaccgtaaaccgtaaacgggtccctaacccgttaccgtcggggtaccaacggacccccgaaacgggacccccaaaccccaacgttccgtactaaccccg

SEQ ID NO: 434708 - DNA, 501 bp, Homo sapiens
  misc_feature: GZ8MTXP02JHJP4.51.81.H04.1.454.CMB.2.raw
  modified_base (329)..(329): a, c, t, g, unknown or other
  modified_base (403)..(403): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaacccatattcttattggtaccagcagaagccaggccaggcccctgtgttgttgatatataaagacactgagaggccttcagggactccctgagcgattcnctggctccacctcagggacatggtcacattgaccatcagtggagtccaggcagaagcgaaggctgactatttcngtcaattctcagacatcagtggtacttatgtcttcggaactgggaccaaggtcaccgtctaggtcacgccaacggacccaacccgctcgtacacttcc

SEQ ID NO: 434709 - DNA, 618 bp, Homo sapiens
  misc_feature: GZ8MTXP02JLL1W.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagagccggcaggcccctgtgtgtgatgtataaagacactgagacggccctgagggactcccgtgacgcgacttctcgtcggctcgaggtcaggggacaaacgggtcacgtagttcgggccctagtaccgaggttacggacgtccgagggccgaagacgggacgaagggcctagacttaagttattagtacctaaagtacaaaacgagaacctaccgtaagtttacggtaactttaagtcgttaccgttacggtaaactcggtaccgaaaccgtaaagggtaccctacccggttccgtacggggttaccaaccggtaccccgaaaacgggaccccaaaccccgtacgttcggtacctaacccg

SEQ ID NO: 434710 - DNA, 603 bp, Homo sapiens
  misc_feature: GZ8MTXP02HR2SR.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggccaggcccctgtgttggtgatgtaataaagacactgagacggccctgagggactcccgtgagcgtattctcctggcctcgaggtcgagggacacgtcacagttcggccatcgaggtggacgtccgaaggcgaggaggacgaggctagaacttattagtgtacaatacaaacagacacctagttacggtaacttagtcgttacgttacggtaaactcggaccgtaaccgtaaacgggtccctacccggttaccgttacggggtaccaaccggacccccgaaaacgggtcccccaaaaccccctcggtaccgttaccctaaccgtttacccgtttacccccg

SEQ ID NO: 434711 - DNA, 510 bp, Homo sapiens
  misc_feature: GZ8MTXP02FZF2C.51.81.H04.1.454.CMB.2.raw
  modified_base (313)..(313): a, c, t, g, unknown or other
  modified_base (499)..(499): a, c, t, g, unknown or other
  modified_base (506)..(506): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatacattgaccaaaccgatatgcttattggtaccagcagaagccgggccaggcccctgtgttggtgatgtataaagacactgagaggccctnaggggatccctgagcgattcctctggctccgaggtcagggcaacggtcacattggccatcagtggagtccgaggcaggagacgagggctagactattatgtacaatacaacagacaccattggtacttatgtcttcggaactgcgacaagtccacgtccgtaggtcacgccaacggccaaccccancgtaccnctcg

SEQ ID NO: 434712 - DNA, 660 bp, Homo sapiens
  misc_feature: GZ8MTXP02GGSUB.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagagccggcaggccctgtgtggtgatgtataaagacactgagaggccctgagggactcccgtgagcgattctcgtggctcgaggtcagggacacgggtcactagttcggacctatcgaggtcggacgtcccgagggcaaggacgggacggacggggcttaggaacttaagtttattaggtactaaattacgaaacgaggtaacctaacccgtaagtttacgggtaacctttagttacggttaccgtttacgggaaaccttacggaccggtaaacccgtaaacggggttcccgtaaacccgggttcccgttacgggggtacccaaccggtacccccgaaaacggggacccccctaaaacccccgtaccgttaccggttacccgtaacctttacccgttttccccccgg

SEQ ID NO: 434713 - DNA, 528 bp, Homo sapiens
  misc_feature: GZ8MTXP02IDMER.51.81.H04.1.454.CMB.2.raw
  modified_base (330)..(330): a, c, t, g, unknown or other
  modified_base (429)..(429): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggtacagcagaagccgggccaggcccctgtgttggtgatgtataaagacactgagaggccctgagggatccctgagcgattcnctggctccgaggtcaggggacaacggtcacattggccatcagtggagtccaggcaggaggacgaggctagactattattgtacaatcaacagacaaccnttaggtacttagtgtacttacggaactcgccgaacctaaagggtccaacccgttcgtcgggtacaaccgccaacggcccaaaccccgtctacgtctacc

SEQ ID NO: 434714 - DNA, 569 bp, Homo sapiens
  misc_feature: GZ8MTXP02F2MK9.51.81.H04.1.454.CMB.2.raw
  modified_base (235)..(235): a, c, t, g, unknown or other
  modified_base (308)..(308): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtgttggtgatgtaataaagacactgagaggccctnagggactcccgtgagcgattctctggcctcgaggtcagggacacgggtcactagttcggccatcagtggagtccagggcaggaggacgaggctagacttattattgtacaaatcaaacagactaaccagttaggtacttagtcgtcttacggaaacttcggacgaaccgtaaaggtccaacccggttccgtcggggtaccacggtaccccaaacgggacccccaaaacccctcgtacggtacctaaccgtcctttaccccg

SEQ ID NO: 434715 - DNA, 521 bp, Homo sapiens
  misc_feature: GZ8MTXP02FNF4A.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggactcccgtgagcgattctctggctccaggtcaggggacaacggtcacattggccatcagtggagtccaggcagaggacgaggctagacttattattgtacaatacaacagaacacaattgtaacttatgtcttacggaactgacgaccaaaggtccaccgtcctgggtaccaagccccaacggcccaaccccgactcgtctaccg

SEQ ID NO: 434716 - DNA, 486 bp, Homo sapiens
  misc_feature: GZ8MTXP02GTPG0.51.81.H04.1.454.CMB.2.raw
  modified_base (232)..(232): a, c, t, g, unknown or other
  modified_base (303)..(303): a, c, t, g, unknown or other
  modified_base (323)..(323): a, c, t, g, unknown or other
  modified_base (401)..(401): a, c, t, g, unknown or other
  modified_base (471)..(471): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagagccggccaggcccctgtgttggtgatgtataaagacactgagaggccctnagggatccctgagcgattcnctggctcaggtcagggacacggtcacattgccatcagtgagtccagcagagacgaggctgactatacttgcaatcaanagacaccattggtacttatgtcttcggactgcgacaagtcacgtcctaggtcagcccaaggcccaacccnctcgtcacgtctccg

SEQ ID NO: 434717 - DNA, 535 bp, Homo sapiens
  misc_feature: GZ8MTXP02JE8Z1.51.81.H04.1.454.CMB.2.raw
  modified_base (235)..(235): a, c, t, g, unknown or other
  modified_base (327)..(327): a, c, t, g, unknown or other
  modified_base (388)..(388): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggcaggcccctgtgttggtgatgtataaagacactgagaggccctgagggatccctgagcgattcnctggctccaggtcagggacacgggtcacagttggccatcagtgagtccgagcagaggacgngctgactattattgacaatcaaacagacaaccattcggtacttatcgttcttacggaactcggacgaaccgaaggtaccaaccggttcctcggggttaccacgacccgaaaggccccaaaccccacgtcgtaccacctcttccccgg

SEQ ID NO: 434718 - DNA, 690 bp, Homo sapiens
  misc_feature: GZ8MTXP02GL21F.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgaggccctcctatgagctgacacagcccaccctcggtgtcagtcgtccccaggacagacggccaggatcacctgctctggagatgcattcgacccaaacgatatgtcttattggtaccagcagaagccggccacggcccctgtgttggtgatgtaataaagacacgtgagacggccctcgagggactccgtgagcgtattctccgtggcctcgaggtcgagggaacacggtcactagttcgacctatcgagaggtttttttttttttttttttttttttttttttacgaccgacgggacgaacggaaggggaacgggaacgggacgtacgtaacgttaacgtttaagtttagttaacgtaaactaacgaaacaaacgaaccgtaacctaacgtttacggtttaacgtttaacgtttacgtttacgtttacggtaacgttacggtaccggtaaccgtaaacggtaccgtacccggttacccgtacgggtaccgaaccgaccccgaaaccgacccgaaccccgtacctaccgtacctaccgtaccgttcccg

SEQ ID NO: 434719 - DNA, 499 bp, Homo sapiens
  misc_feature: GZ8MTXP02FIJ77.51.81.H04.1.454.CMB.2.raw
  modified_base (467)..(467): a, c, t, g, unknown or other
  modified_base (489)..(489): a, c, t, g, unknown or other
tcagcgatcgtatacacgaccggtgctcgatttagtagtgtagattcgcgggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcaggggatccctgagcgattctctggctccaggtcagggacaacggtcacattggccatcagtggagtccaggcagaggacgaggctagactattatgtcaatcaacagacaccattggtacttatgtcttcggaactgcgacaaggtcaccgtcnggtcaagcccaaggccaacccnctacgctacc

SEQ ID NO: 434720 - DNA, 508 bp, Homo sapiens
  misc_feature: GZ8MTXP02F9PR6.51.81.H04.1.454.CMB.2.raw
  modified_base (238)..(238): a, c, t, g, unknown or other
  modified_base (312)..(312): a, c, t, g, unknown or other
  modified_base (388)..(388): a, c, t, g, unknown or other
  modified_base (470)..(470): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctnagggatccctgagcgattctctggctcaggtcaggggacaacggtcacattggccatcgagtggagtcgaggcagnggacgaggctagactattattgtcaatcaacagacacctattggtacttatgtcttacggactgacacgaaggtcaccgtcngggtacaacgacccaaggcccaaccccactcgtctacc

SEQ ID NO: 434721 - DNA, 573 bp, Homo sapiens
  misc_feature: GZ8MTXP02F2XP3.51.81.H04.1.454.CMB.2.raw
  modified_base (562)..(562): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgctattcgaccaaaccgatatgctttattggtaccagcaagagccgggcacggcccctgtgttggtgatgtaataaagacactgagacggccctgaggggtactcctggacgcgtacttctctgggtcctcgaggtcgagggtacgaaacggtcacgattcgggcctatcgaggttggacgtccgagggacaagggacgggaacggaggtcgtacgaacttatttaacgttgtacaaattcaaacagaaccactattcggtaacttagtagtcgttacgaactgaccgaacgtaacggtccaccgttcgtggtcaaccgacccgaacggacccaacccnctcgcctaccg

SEQ ID NO: 434722 - DNA, 568 bp, Homo sapiens
  misc_feature: GZ8MTXP02JMPU8.51.81.H04.1.454.CMB.2.raw
  modified_base (280)..(280): a, c, t, g, unknown or other
  modified_base (543)..(543): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggngatgtataaagacactgagacggccctgagggatccctgagcgattctccgtgctccaggtcagggacacggtcactagttggacccatccaggtgagtcccaggcaggagggacgaggctgaactattatgtacaattacaactagacaacctattaggtacttagtcgttacgttacggaaacttcgaccgtaaaccgtaagggtccctaacccggttccgtacggggtaccacggaccccgtaaggcccccaaaaccccncgtacgtacccaccgttccttcccg

SEQ ID NO: 434723 - DNA, 583 bp, Homo sapiens
  misc_feature: GZ8MTXP02JGNMH.51.81.H04.1.454.CMB.2.raw
  modified_base (334)..(334): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcaggcccctgtgttggtgatgtataaagacactgagaggccctcgagggactccctgagcgattcncgtgctccgaggtcaggggacaacggtcacagttggccatcgagtggacgtccagggcaggaggacggaggctagaacttagttattgtacaatacaacagtaacacctagttaggtacttatacgtctacggtaactcgtaccgaaccgtaaacggtacgtacccggttaccgttacggggtacaacccggacccgtaaaaccggggtacccccaaaaccccgtaaccgttcgtaacccttaaccccg

SEQ ID NO: 434724 - DNA, 501 bp, Homo sapiens
  misc_feature: GZ8MTXP02F71UQ.51.81.H04.1.454.CMB.2.raw
  modified_base (235)..(235): a, c, t, g, unknown or other
  modified_base (328)..(328): a, c, t, g, unknown or other
  modified_base (407)..(407): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtgtggtgatgtataaagacactgagaggccctcagggactcccgtgagcgattcnctggctcaggtcagggacacggtcacattgccatcagtgagtccgagcagagacgagctgactattatgtacaatcaanagacacctattggtacttatgtcttcggaactgacgacaaggtccaccgtctcgggtcacgcccaacggcccaacccactcgtacactcttccc

SEQ ID NO: 434725 - DNA, 508 bp, Homo sapiens
  misc_feature: GZ8MTXP02ILNV7.51.81.H04.1.454.CMB.2.raw
  modified_base (234)..(234): a, c, t, g, unknown or other
  modified_base (413)..(413): a, c, t, g, unknown or other
  modified_base (490)..(490): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggccacggcccctgtgttggtgatgtaataaagacactgagaggccctgagggactcctgagcgattctctgctcaggtcagggacacggtcacattgccagtcagtgacgtccaggcaggaggacgaggctagactattatgtacaatcaanagacactattgtacttatgtctacgaactgcgaacgaggtccaccgtctgggtaccacgacccgaagcccaaacccnctacgtccacttctcccg

SEQ ID NO: 434726 - DNA, 620 bp, Homo sapiens
  misc_feature: GZ8MTXP02IHVP6.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggacagcagaagccggccacggcccctgtgttggtgatgtaataaagacactgagacggccctcgagggactcccgtgacgcgacttctcgtgcctcgaggtcgagggacaacgtcactagttcggaccatcgagtaggacgtacccgagggcaggagggtaaccgaggtcctaggtaacttaatttagttcgtactaaataccaaacgaagaaccaaccgtaagtttacggtaactttattcggtacgttacggtaaaacttcggaccggtaaacctaaacgggtcctaaccccggtccgttacggggaccaaccggacccccgaaaccgggacccctaaacccccctacgttaccggttaccctaaccccg

SEQ ID NO: 434727 - DNA, 552 bp, Homo sapiens
  misc_feature: GZ8MTXP02JXNHF.51.81.H04.1.454.CMB.2.raw
  modified_base (234)..(234): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggataacctgctctggagatgcattgccaaacgntatgcttatggtaccagcagaagcggccaggcccctgtgttggtgatgtataaagacactgagaggccctcgagggactcccgtgagcgtattctcgtggctccgaggtcaggggacaacgggtcacgattcggccatcgaagttggagtccgaggcgaggacgggacgaggactggaacttattattgtacaaattacaacagacacctattcggtaacttattcgtcttacggaactgaccgacgaaaggtcacccgtcgtcgggtacacggaccccaaggaacccctaacccactcgtccactctcgttaccccc

SEQ ID NO: 434728 - DNA, 558 bp, Homo sapiens
  misc_feature: GZ8MTXP02H4PVU.51.81.H04.1.454.CMB.2.raw
  modified_base (270)..(270): a, c, t, g, unknown or other
  modified_base (313)..(313): a, c, t, g, unknown or other
  modified_base (323)..(323): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggacagcagaagccggccaggccctgngttggtgatgtataaagcactgagaggccctcagggatcccgngagcgtatcnctgctcgaggtcgaggacacgtcaacagttgaccatacagtgacgccgaggacgaaggaggacgaggctagtaacttattaattagtactaaatacaaaacaagaacaactaacgttagttaacgttagttacgttacgttacgtaacgtacgacgaaccgtaacgtaccgtaccgtaccgtacggtacgacgacccgaaccgacccaacccacctacgtacctacctacctccg

SEQ ID NO: 434729 - DNA, 562 bp, Homo sapiens
  misc_feature: GZ8MTXP02H4MM9.51.81.H04.1.454.CMB.2.raw
  modified_base (238)..(238): a, c, t, g, unknown or other
  modified_base (528)..(528): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtaataaagacacgtgaaggacggccctagagggactccccgtagacggcgtacttctcgtggcttcgaggttcgaggggaacctaaacggtcaaacgtagtttcgggccctaatccaaaggtggaacgtcccgaagggccgaaggagggaacggaggacctgaacttatttattgtacaaatcaaacagacactagttgtaacttatgtcttacggactgacgaacaaggtcaccgtcgnggtcaacgcccaacgcccaacccactcgtacacc

SEQ ID NO: 434730 - DNA, 497 bp, Homo sapiens
  misc_feature: GZ8MTXP02HYP2L.51.81.H04.1.454.CMB.2.raw
  modified_base (234)..(234): a, c, t, g, unknown or other
  modified_base (328)..(328): a, c, t, g, unknown or other
  modified_base (409)..(409): a, c, t, g, unknown or other
  modified_base (427)..(427): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggccaggcccctgtgttggtgatgtataaagacactgagaggccctcgagggatccctgagcgattcnctggctcaggtcagggacacgggtcacattggccatcagtgagtccaggcagagacgaggctgactattatgtcaatcaanagacaccattgtacttangtcttcgaactgacgacaaaggcaccgtcctgggtcagcccaaggcccaaacccgctgtaccactctccg

SEQ ID NO: 434731 - DNA, 537 bp, Homo sapiens
  misc_feature: GZ8MTXP02FXCCF.51.81.H04.1.454.CMB.2.raw
  modified_base (515)..(515): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctcctggctcaggtcagggacacggtcacattggccatcagtgagtccaggcaggaggacgaggctgactatattgtacaaatcaaacagacacctattggtacttatgtcttacggaactgacgaaccgaaggtccaacccggttcctcggggtaccacggaccccgaaacggccccaaaacccccnctacgtccaacctccttcccgg

SEQ ID NO: 434732 - DNA, 582 bp, Homo sapiens
  misc_feature: GZ8MTXP02JRQJC.51.81.H04.1.454.CMB.2.raw
  modified_base (220)..(220): a, c, t, g, unknown or other
  modified_base (375)..(375): a, c, t, g, unknown or other
  modified_base (385)..(385): a, c, t, g, unknown or other
  modified_base (393)..(393): a, c, t, g, unknown or other
  modified_base (409)..(409): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggactcacctgctcgtgganatgctatcgaaccaaacgtatatgtacttagttggtaccagcagaacgccggcacggcccctgtgttggtgatagtaataaagacacgtgagacgccctgagggtacttccgagacgtcgtattctcgtcggctcgaggtcgacggacacgtcangttcgctagngagtgacncgagcgaggaggacgngtacgtagtacgttatagttgactatacaacgacaccacttagttacgtacttatcgttacgttacgaacttcggaccgtaaacgtacgtaccgtacccggtacgtacggaccgacgaccccgaaccggaccccaaaacccgtcgtaccgtacctaccgtaccgtttcccccg

SEQ ID NO: 434733 - DNA, 635 bp, Homo sapiens
  misc_feature: GZ8MTXP02IIOW2.51.81.H04.1.454.CMB.2.raw
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtacagcagaagccggcaggcccctgtgttggtgatgtataaagacactgagaggccctcgagggactcctgacgcgattctcctggctcgaggtcgagggacacgggtcacgtagttcggaccagtcaggtaggacgtacccagggcaagggacggaacgaggtctagaacttattaagttgtactaaattacaaaacgagtaaccaaccctaagtttaggttaacctttagttcggtttaccttacgggaaacttcggaccgtaaaccgtaaacgggttcccaaacccgggttacccgttacgggggttaccaacggacccccgaaaagggacccccaaaaccccgtaccgttacggtaccctaacccgtttcctttaacccccgg

SEQ ID NO: 434734 - DNA, 525 bp, Homo sapiens
  misc_feature: GZ8MTXP02GDY3X.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgtggtgatgtataaagacactgagaggccctcagggatccctgagcgattctctggctcaggtcagggacacggtcacattggccatcagtggagtccgaggacaggaggacgagggctaggactattattgtacaaatcaaacagacaccagttaggtactttatgtcttcggaaacttgacgaccaaaggtccaccgtcctggggtcagcccaaggcccaaaccccgactgacctactcttacccg

SEQ ID NO: 434735 - DNA, 513 bp, Homo sapiens
  misc_feature: GZ8MTXP02II9B4.51.81.H04.1.454.CMB.2.raw
  modified_base (233)..(233): a, c, t, g, unknown or other
  modified_base (293)..(293): a, c, t, g, unknown or other
  modified_base (386)..(386): a, c, t, g, unknown or other
  modified_base (395)..(395): a, c, t, g, unknown or other
  modified_base (410)..(410): a, c, t, g, unknown or other
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttattggtacagcagagcggcaggccctgtgtggtgatgtataaagacactgagnggccctgagggatccctgagcgattctcctggctccaggtcaggacacgggtcacagttcgccatcagtgagtccgaggcaggagacgaggcngtactattnttagtcaaatcgaanagacaaccattggtacttatgtcttcgaactgacgacaggtccaccgtccgttgggaccacgacccgaaggccccaaaccctctacgtcctacctcttccccg

SEQ ID NO: 434736 - DNA, 494 bp, Homo sapiens
  misc_feature: GZ8MTXP02HNKRR.51.81.H04.1.454.CMB.2.raw
  modified_base (307)..(307): a, c, t, g, unknown or other
  modified_base (351)..(351): a, c, t, g, unknown or other
  modified_base (386)..(386): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtataaagacactgagaggccctnagggatccctgagcgattctctggctcaggtcagggacacggtnacattgccatcagtgagtccagcagagacgaggcngatattatgtacaatcaacagacaccattggtacttatcgtcttcgaactgacgaccaaggtcaccgtctcgggtcacgcccaaggcccaacccactcgcactctccg

SEQ ID NO: 434737 - DNA, 574 bp, Homo sapiens
  misc_feature: GZ8MTXP02GAVSR.51.81.H04.1.454.CMB.2.raw
  modified_base (383)..(383): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccacttattcttattggtaccagcagaagccaggccaggcccctgtgttgtgatatataaagacactgagaggccttcgagggatccctgagcgattctctggctccactcaggacaatggtcacattcgaccatcagtgatcccgggggaanacgaagaacgacgacggtactagtacttattctagtactaacttctagacgtactatacgtagttacgttacttagttcgttacgtacggtaacgtacgggtaaccgtaacggtaccgaaccggttacgtacggtaccgaccgacccgaacggacccctaaaccctacgtacgtacctaccgttccgtccg

SEQ ID NO: 434738 - DNA, 573 bp, Homo sapiens
  misc_feature: GZ8MTXP02GJIP8.51.81.H04.1.454.CMB.2.raw
  modified_base (218)..(218): a, c, t, g, unknown or other
  modified_base (235)..(235): a, c, t, g, unknown or other
  modified_base (322)..(322): a, c, t, g, unknown or other
  modified_base (426)..(426): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttattggtaccagcagaacgccgggccaggcccctgtgttggtgatgtaataaagacactgagaggccctcagggatcccgngagcgattctcgtggctcgaggtcagggacacgggtcactagttgccatcgagtggagtccgaggcaggaggacgaggctaggacttattatgtacaatacaanagacctactaagttcggtaactttagtcgttcttacggaaacttcggacgtaaccgaaaggtcccaaccggttccgtacggggttccaacggaccccgaaacgggacccccaaaccccgtacgtcgtaccacctttccgttaccccg

SEQ ID NO: 434739 - DNA, 559 bp, Homo sapiens
  misc_feature: GZ8MTXP02HEW55.51.81.H04.1.454.CMB.2.raw
  modified_base (236)..(236): a, c, t, g, unknown or other
  modified_base (543)..(543): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattgataccagcagaagccgggccaggcccctgtgtggtgatgtaataaagacactgagacggccctcgagggactcccgtagagcgtattcctcgtgctccgaggtcaagggcaacggtcactagttcggaccatcgaagtggacgtccgaggcaggagacgaggctagacgtattattgtacaatcaaagagaaccacctagttacgttacttagtacgttcgttacgaaccgttgaccgaaaccgacggttaccacgtccgtcgggtaccacgaacccgaacggaccctaaacccgntaccgtccacttcccg

SEQ ID NO: 434740 - DNA, 497 bp, Homo sapiens
  misc_feature: GZ8MTXP02GZC2J.51.81.H04.1.454.CMB.2.raw
  modified_base (216)..(216): a, c, t, g, unknown or other
  modified_base (430)..(430): a, c, t, g, unknown or other
  modified_base (464)..(464): a, c, t, g, unknown or other
  modified_base (491)..(491): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctntggagatgcattgccaaacgatatgcttatggtaccagcagaagccggcagcccctgtgtggtgatgataaaagacatgagaggccctcagggatccctgagcgattctctggctccaggtcagggacaaacggtcacattggccatcagtggagtccaggcgagaggacgaggctagactaattatgtacaatcaacagacacatgtacttangtctacggaactgacgaaccaaggttcaccgtcnggtcaagcccaaaggccaaaccctacncgtcac

SEQ ID NO: 434741 - DNA, 519 bp, Homo sapiens
  misc_feature: GZ8MTXP02IYHO1.51.81.H04.1.454.CMB.2.raw
  modified_base (218)..(218): a, c, t, g, unknown or other
  modified_base (236)..(236): a, c, t, g, unknown or other
  modified_base (309)..(309): a, c, t, g, unknown or other
  modified_base (412)..(412): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaaccgntatgcttattggtaccagcagaagccgggccaggcccctgtgtggtgatgtataaagacactgagaggccctnagggatccctgagcgattctcctggctcgaggtcaggacacgggtcacattgccatcagtgagtccaggcagagacgaggctgactattattgtacaatcaanagacaccaagttgtattatgttctaggaaactgacgacgaaggtccaaccgtcgtcgggtacacgacccgaacggcccaaacccctacgtcgacctactctttcccg

SEQ ID NO: 434742 - DNA, 722 bp, Homo sapiens
  misc_feature: GZ8MTXP02F452O.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcacctgctctggagatgactattcgaccaaacgtatatgtactttagttcggtaccagacgaagaacggcccggaccgaccgggcccccttggttggttgggtagtagttaggttaaataaaacggacctaacgtaggaacggaccggtcccctacggaacggggtacctccccgtagacgtcgtactttcctccgtcgtcccttaccgacggtacggaacgggaacctaccggggtacaacgtagttccggacctagtcgaggtggacgtccgaagggacaagggacggaacggcggtacgtagtaacttaattagtttagtactaaacttacgaacaacaaccaacctagtttacggttaacttagttacgttacgtaacggtaaacgtcggaaccgtaaaccggtaaacgttcccgtaaaccgttccggttacgggtaaaccgaccggaaccccggaaaaccggacccccaaaacccgtcggttacctaccggtaaccctttcggtttaacccccg

SEQ ID NO: 434743 - DNA, 558 bp, Homo sapiens
  misc_feature: GZ8MTXP02JNG7D.51.81.H04.1.454.CMB.2.raw
  modified_base (439)..(439): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgatatgcttatggtaccagcagagccgggcaggcccctgtgtggtgatgtaataaagacactgagacggcccctagagggactccctgacgcgtacttctcgtggctccgaggtcaggggaccaaacgggtcactagttcggaccatcgagtggatccgaaggcgagacggacgtaggctagacttagtattgtactaaanacaacgacgacactagttacgtacttagtacgttcgtacgaacgtcgaccgaacgtacgtccgaccgtcgtacggaccaaccgacccgaacgaccccaacccgtctaccgtacctaccg

SEQ ID NO: 434744 - DNA, 569 bp, Homo sapiens
  misc_feature: GZ8MTXP02H4S5A.51.81.H04.1.454.CMB.2.raw
  modified_base (281)..(281): a, c, t, g, unknown or other
  modified_base (318)..(318): a, c, t, g, unknown or other
  modified_base (420)..(420): a, c, t, g, unknown or other
  modified_base (448)..(448): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggccaggcccctgtgttggngatgtaataaagcactgagacggcctgagggactccngacgcgattctccgtggctcgaggtcagggacacggtcacagttgccatcagtgagtccgaggcaggagacgaggctagacttattatgtacaaatacaaanagaccaacctagttacggtaactttagngttaccttacgggaaactcgaccgaaccgtaagggtcctaacccggtcgtacggggtaccaaccgaccccgaaacggaccccaaaacccctcgtaccgtacctaaccttccgtttccccgg

SEQ ID NO: 434745 - DNA, 629 bp, Homo sapiens
  misc_feature: GZ8MTXP02G3DR0.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatgtaccagcagagccggcacgccctgtgtggtgatgtataaagacactgagacggccctgagggactcccgtgagcgtattctccgtggctccgaggtcgaggggacacgggtcacgtagttcggacctagtcagggttggacgtacccgagggacgaaggacgggacggaggtctaggtaacttattagttagtactaaatacaaacgagaacctaaccgtaagtttacggtaactttagttacgttaccgtttacgggtaaaactcggtaaccgaaaaccgtaacgggttaccctaacccggttccgttacggggtaccaacggaccccgaaacgggaaccccaaacccccgtactaccggtacctacccgttctttcccccgg

SEQ ID NO: 434746 - DNA, 512 bp, Homo sapiens
  misc_feature: GZ8MTXP02I7JFQ.51.81.H04.1.454.CMB.2.raw
  modified_base (415)..(415): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagaggccctgagggatccctgagcgattctctggctccaggtcagggacacgggtcacattggccatcagtggagtccaggcaggaggacgaggctgactattattgtacaatcaanagacacattgtacttagtgtcttacggaatgacgacaaggtcaccgtcctcggggtacacgacccgaaggcccaaacccactacgtcactcttcccg

SEQ ID NO: 434747 - DNA, 502 bp, Homo sapiens
  misc_feature: GZ8MTXP02JSJ84.51.81.H04.1.454.CMB.2.raw
  modified_base (311)..(311): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctnaggggatcccgtgagcgattctctggctccaggtcaggggacaacggtcacattggccatcagtggagtccaggcagaggacgaggctgactattatgcaatcaacagacaccattggtacttatgtctcggaactgacgtacaaggtcaccgtctgggtcaacgcccaacggcccaacccactcgtcacc

SEQ ID NO: 434748 - DNA, 478 bp, Homo sapiens
  misc_feature: GZ8MTXP02JTX57.51.81.H04.1.454.CMB.2.raw
  modified_base (405)..(405): a, c, t, g, unknown or other
  modified_base (422)..(422): a, c, t, g, unknown or other
  modified_base (447)..(447): a, c, t, g, unknown or other
  modified_base (468)..(468): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgatgcctcctatgagctgacacagccaccctcggtgtcagtgtccccaggacagacggccaggatcacctgctctggagatgcattgccaaaccgatatgcttattggtaccagcagaagcggcaggcccctgtgtggtgatgtataaagacactgagaggccctcagggatccctgagcgattcctctggctcaggtcagggcaacgggtcacagttggcatcagtgagtccaggcagagacgaggctgactatatgcaatcaanagacacattgtacttantctcggaatgacgacagtcacgtcnggtcagccgaaggccacccgntcgtcactcc

SEQ ID NO: 434749 - DNA, 547 bp, Homo sapiens
  misc_feature: GZ8MTXP02JENXP.51.81.H04.1.454.CMB.2.raw
  modified_base (219)..(219): a, c, t, g, unknown or other
  modified_base (332)..(332): a, c, t, g, unknown or other
  modified_base (400)..(400): a, c, t, g, unknown or other
  modified_base (420)..(420): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgatatgcttattggtaccagcagaagccggccacggcccctgtgttggtgatgtataaagacactgagaggccctgagggactccctgacgcgattcnctcgctcgaggtcaggacacgggtcacagttcgacatcagtggagtccgaggcaaggaggacgaggcngactagtatgtacatacaanagacacattaggtacttatcgtacgtacggtaactcgacgtaaccgaggtaccctaaccgtccgtacgggtacaccgacccgaaaccggacccaacccgtactcgtacccaccgttacctttccccg

SEQ ID NO: 434750 - DNA, 561 bp, Homo sapiens
  misc_feature: GZ8MTXP02JBPSY.51.81.H04.1.454.CMB.2.raw
  modified_base (331)..(331): a, c, t, g, unknown or other
  modified_base (425)..(425): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtataaagacactgagaggcccctgagggactccctgagcgattcnctggctcaggtcagggacacggtcacagttcggccatcgagtggagtcccgaggcaggaggacgagggctagactattattgtactaaatcaanacgacacctattcggtaactttagtcgttcttacggaaactggaccgaccgaaaggtccaaccggttccgtcgggtaccaccggaccccgaaacggccccaaaaccccgacgtcgtaccaaccgtttcttaccccg

SEQ ID NO: 434751 - DNA, 504 bp, Homo sapiens
  misc_feature: GZ8MTXP02GX1RA.51.81.H04.1.454.CMB.2.raw
  modified_base (307)..(307): a, c, t, g, unknown or other
  modified_base (326)..(326): a, c, t, g, unknown or other
  modified_base (421)..(421): a, c, t, g, unknown or other
  modified_base (470)..(470): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggcccctgtgttggtgatgtaataaagcactgagagccctnagggatcctgagcgattcnctggctcgaggtcaagggacacggtcaacagttcggccaatcagtggacgtccgaggcaggaggacgaggctgaactattattagtcaaatcaanagacactaagttgtacttatgtacttagactgcgaccaaggtcacgtcnggtcagcccaagccctaaccactctcactctccg

SEQ ID NO: 434752 - DNA, 656 bp, Homo sapiens
  misc_feature: GZ8MTXP02J3OKE.51.81.H04.1.454.CMB.2.raw
  modified_base (218)..(218): a, c, t, g, unknown or other
  modified_base (235)..(235): a, c, t, g, unknown or other
  modified_base (318)..(318): a, c, t, g, unknown or other
  modified_base (458)..(458): a, c, t, g, unknown or other
  modified_base (465)..(465): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatggtaccagcagaacgccggccaggccctgtgtggtgatgtaataaagcactgagacggcctcgagggactccgngagcgtattctccgtcggctaccgaggtcgacggggacacgggtcaaacgtcgttcggaccctagttacgagggttgggaaaccgtccgaacgggacgaagggacgggacggtaggactagtaacttattagtgtacaanacaacanaccaacctagttacggttattaacgtgttaccgttacggaaacttcggacccgtaaaccgtaaacgggtcccgtaaaccccggttccggttacgggtaccccgtaacggaccccccgtaaaacggggtaacccccccaaccccgtaaaccggttcccgtaccctaaaccccgtttcccgttttaccccccg

SEQ ID NO: 434753 - DNA, 538 bp, Homo sapiens
  misc_feature: GZ8MTXP02JBOQV.51.81.H04.1.454.CMB.2.raw
  modified_base (218)..(218): a, c, t, g, unknown or other
  modified_base (412)..(412): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaacccatattcttattggtaccagcagaagccaggccaggcccctgtgttgtgatatataaagacactgagaggccttgagggactccctgagcgtattctccgtggcctccacctcgagggacagtggtacactattgaccatcagtgacgtccgaggcaagaagacggagctgactatttcngtacaattctacagaccatcgagtggtacttagtgtcgttacggaacttcgggacctaacgggtctaccggtctacgggtcacggaacccaacggacccaaccccgacgtcgtactaccgttcccg

SEQ ID NO: 434754 - DNA, 501 bp, Homo sapiens
  misc_feature: GZ8MTXP02FUNHS.51.81.H04.1.454.CMB.2.raw
  modified_base (234)..(234): a, c, t, g, unknown or other
  modified_base (407)..(407): a, c, t, g, unknown or other
  modified_base (486)..(486): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagagccggcaggcccctgtgtggtgatgtataaagacactgagagccctcagggatcccgtgagcgattctctggctcaggtcagggacacggtcacattcggccatcagtgagtccaggcaggaggacgaggctgactatattgtacaatcaaanagaacacctattgtacttagtgtactaggaactggacacgaggtccacgtcgtgggtcacgaccaaggcccaacccacngtaccacgtctcccg

SEQ ID NO: 434755 - DNA, 532 bp, Homo sapiens
  misc_feature: GZ8MTXP02HQC8J.51.81.H04.1.454.CMB.2.raw
  modified_base (424)..(424): a, c, t, g, unknown or other
  modified_base (436)..(436): a, c, t, g, unknown or other
  modified_base (518)..(518): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgacttattggtaccagcagaagccggcacggcccctgtgttggtgatgtaataaagacacgtgagacggccctcgaggggtactcccgtgacgcgtattcctcgtgctcgaggtcgagggacacgggtcatagttcggccaatcgacgtgggactccgaggcaggagacgaggctagacttattntgtacatacaanagacactattcgtattatgtacttggaactgacgacgaaggtccaccgtcgtcggacacgcccgaaggcccaaacccacgtntaccacttctcccg

SEQ ID NO: 434756 - DNA, 579 bp, Homo sapiens
  misc_feature: GZ8MTXP02H235T.51.81.H04.1.454.CMB.2.raw
  modified_base (329)..(329): a, c, t, g, unknown or other
  modified_base (425)..(425): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagcactgagaggccctgagggatccctgagcgattcnctggcctcgaggtcagggacacggtcacgtagttggccatcgagtgggagtccgaggcaaggaggacgaggctagacttattatgtacaatcaaangacaccattggtactttagtcgttacgttacgaaacttcggacgtaaccgaaacggtcctaacccggttccgtacgggggtaccaacggacccccgaaaacgggcccccaaaaccccgtacgttaccggtacctaacctttaccgtttcccccg

SEQ ID NO: 434757 - DNA, 585 bp, Homo sapiens
  misc_feature: GZ8MTXP02G9IP5.51.81.H04.1.454.CMB.2.raw
  modified_base (238)..(238): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgtggtgatgtaataaagacactgagacggccctgagggtactcccgtgagcgactttctcgtggcctcgaggtcaggggacaaacgggtcacagttcggccatcgagtaggacgtccgaggcaggaggacgagggctagactattattgtacaagtcaaacgagaaccaccgtattaggtactttaagtcgttacgttaccggtaaacgtgaccgaaaccgtaaacggtccgtacccgttccgtcggggtacccaacggcccccgaaacgggacccccaaaaccccgtcctacggtcccttaacccg

SEQ ID NO: 434758 - DNA, 545 bp, Homo sapiens
  misc_feature: GZ8MTXP02JN7Q2.51.81.H04.1.454.CMB.2.raw
  modified_base (400)..(400): a, c, t, g, unknown or other
  modified_base (423)..(423): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccacggcccctgtgttggtgatgtataaagacactgagaggccctcagggactcccgtgagcgattctcctggctcgaggtcgagggacacggtcactagttgccatcgagtggagtccgagcgagagggagcggntgactagttattgacaatacaanagacacctattggtacttagtgttcgttacggactcgccgtaacgacggtccgaccggttccgtcgggtaccacgacccgaacggcccaaaccccgtacgtcgtaccacctcgtttccccgg

SEQ ID NO: 434759 - DNA, 583 bp, Homo sapiens
  misc_feature: GZ8MTXP02ISJFS.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattcgaccaaaccgatatgcttattggtaccagcagaagccggcacggcccctgtgttggtgatgtaataaagacacgtgagacggccctgagggactccctgagcgtattctcgtggcctcgaggtcaggggacaacggtcacgtagttggacctatcgaggtaggacgtaccgaggcgaaggacggacggaaggccgtagaacttaatttattgtactaaataccaaacacgaacacctaagtttaggtaactttagtcgtacgttacggtactcgaccgtaaccaaagggtcctaaccgttccgtacggtaccaacgacccgaacggtaccccaaacccgactcgtacctaccg

SEQ ID NO: 434760 - DNA, 554 bp, Homo sapiens
  misc_feature: GZ8MTXP02FS3JC.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctcagggatcccgtgagcgattctcctggctcaggtcagggacacggtcacattggccatcagtggagtccaggcagaggacgaggctgactattattgtacaaagtcaaacagtacaacctattggtacttagtcgttcttacggaacttggacgtaaccgaaacgggtccaacccggttaccgtcggggttaccacggaccccgaaagggccccaaaaccccacgtcgtaccaccgttctttcccgg

SEQ ID NO: 434761 - DNA, 567 bp, Homo sapiens
  misc_feature: GZ8MTXP02ISQW4.51.81.H04.1.454.CMB.2.raw
  modified_base (237)..(237): a, c, t, g, unknown or other
  modified_base (283)..(283): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttattggtaccagcagaagccggcacggcccctgtgttggngatgtaataaagacactgagacggccctgagggatccctgagcgtattctcctgctcgaggtcaggggacacgggtcactagttcgccatcgaagtggacgtaccgaggcaaggagggacgaggtctgaacttagttattgtacaaatacaaacagacaacctagttacggtacttagtacgttctttacgggaaacttcggacgaccgtaaaggtccaaccggttcgtcgggtaccacgacccgaaacggcccaaacccgtctacgtcctacctcgttccccg

SEQ ID NO: 434762 - DNA, 625 bp, Homo sapiens
  misc_feature: GZ8MTXP02FW0CC.51.81.H04.1.454.CMB.2.raw
  modified_base (287)..(287): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgcttattggaccagcagaacgccgggcacggcccctggtgtggnatgtaataaagacacgtgagacggccctgaggggtactcccgtagacgtcgtatttcctcgtggcctaccgaggttcagggggaccaacgggtcacgagttcggaccattcgagtcggagtccagggacaaggacggacgaggcgtacgacgttattagtagtactaaatacaaacgaagaaccaccgtagtttacggtaacttagtcgttacgttacggtaaacttcggaaccgtaaccgtaaacggttaccgtaacccggttcccgtacggggttaccaaccggaaccccgaaacgggacccccaaaacccccgtacgttaccgtaccttaacccg

SEQ ID NO: 434763 - DNA, 682 bp, Homo sapiens
  misc_feature: GZ8MTXP02HLUDI.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgtcttagttggtacagcagaagccggccacggccctgtgtggtgatgtaataaagacactaggagacggcctacgagggtactcccgtaggacgcgtattctccgtggcctcgaggtcgaggaacacggtcactagttcggactagctaggtgacgtcccgaggcgaaggagggacggaggacgtacggtaacttagttaagtttagtaactaaacgttacgaaaacaggaaaccctaaaccgttaagtttaccggttaaactttacgttacggtttacctttaaccgggtaaacgttaccggaaccggtaaaaccggttaaacgggtacccttaaacccgggttcccggttacgggggtacccaaaccggaccccgaaaacccgggacccccaaaacccccgtacgttaccggtaccctaaccgtttccctttaaccccccg

SEQ ID NO: 434764 - DNA, 506 bp, Homo sapiens
  misc_feature: GZ8MTXP02GH3LP.51.81.H04.1.454.CMB.2.raw
  modified_base (234)..(234): a, c, t, g, unknown or other
  modified_base (403)..(403): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgtggtgatgtataaagacactgagaggccctcagggatccctgagcgattctctggctcaggtcaggacacggtcacattggccatcagtgagtccagcagagacgaggctagactattatgtcaatcaanagacaccattgtacttatgtcttacggactgcgaccaaggtcctaaccgtcgtacggggtacacggacccaaaggcccaaaccccactcgtacactcttcccg

SEQ ID NO: 434765 - DNA, 553 bp, Homo sapiens
  misc_feature: GZ8MTXP02IY4T1.51.81.H04.1.454.CMB.2.raw
  modified_base (236)..(236): a, c, t, g, unknown or other
  modified_base (286)..(286): a, c, t, g, unknown or other
  modified_base (426)..(426): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctggagatgcattgaccaaaccgntatgcttattggtaccagcagagccggccaggccctgtgtggtgatgtanaaagacactggagaggccctgagggcttcccgtgagtccgatttctccgtggcctcgaggtcgagggacacggtcacgattcgccatcgaggtcggatccgaggcaggaggacgaggctgactattatgtacaaatcaangacaccagttcggtacttatgttacgttcgaacgttcgacgaaccgtaaagggtccaccggttcgtcgggtaccgacgacccgaaacggccccaaaccctacgtcgtaccctacttccgtttcccgg

SEQ ID NO: 434766 - DNA, 529 bp, Homo sapiens
  misc_feature: GZ8MTXP02GK0YH.51.81.H04.1.454.CMB.2.raw
  modified_base (328)..(328): a, c, t, g, unknown or other
  modified_base (409)..(409): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagaggcctcgagggatccctgagcgattcnctgctcgaggtcagggacacggtcacattgccatcagtgagtccaggcagaggacgaggctgactattatgtacaatcaanagacaccattaggtacttagtgtcttacggaactcgacgacctaagggtccaccgttccgtgggtaccaccgtacccgaaacggccccaaacccacgtacgtaccactttccttacccgg

SEQ ID NO: 434767 - DNA, 500 bp, Homo sapiens
  misc_feature: GZ8MTXP02J1UY3.51.81.H04.1.454.CMB.2.raw
  modified_base (233)..(233): a, c, t, g, unknown or other
  modified_base (379)..(379): a, c, t, g, unknown or other
  modified_base (391)..(391): a, c, t, g, unknown or other
  modified_base (395)..(395): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgccaaacgntatgcttatgtaccagcagaagccggccaggcccctgtgttggtgatgtataaagacactgagaggcctcagggatccctgagcgattctctggctcaggtcaggcacggtcacattgccatcagtgagtccaggcagagcgagcngactattatgtnaatnaacagacaccattggtacttatgtacttacggaaactcgacaccgaaggtcaccgtaccgttgggccacgacccaaggcccaaacccgctacgcactcgttcccg

SEQ ID NO: 434768 - DNA, 583 bp, Homo sapiens
  misc_feature: GZ8MTXP02G8QYD.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaacgntatgcttatggtacagcagagcggcagccctgtgtggtgatgtataaagacactgagaggcctgagggactcctgagcgattctccgtggctcgaggtcgacgggacacgggtcacagttcgccagtcgaggtcggacgtccgaggcgaaggaagggacgagggctagtaacttattacgttgtactaaatacaaacgagaacctaaccgtagtttacggttaactttagttacgttaccgttacgaaaacgttcggacgtaaaccgaacggttcctaaccggtccgttcggggtaccaccgacccgaaacggcccccaaacccgacgtcgtacctacctctttcccg

SEQ ID NO: 434769 - DNA, 508 bp, Homo sapiens
  misc_feature: GZ8MTXP02IHE78.51.81.H04.1.454.CMB.2.raw
  modified_base (418)..(418): a, c, t, g, unknown or other
  modified_base (496)..(496): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccggccaggcccctgtgttggtgatgtaataaagacactgagaggccctgagggatccctgagcgattctctggctcgaggtcaggggacaacggtcacattggcatcagtggagtccgaggcagaggacgaggctagactattattgtacaatcaanagacaccattgtacttatgtcttcggaactgacgacgtaaggtcaccgtccgtggtcaacgcccaacggcccaacccnctcgtactaccg

SEQ ID NO: 434770 - DNA, 541 bp, Homo sapiens
  misc_feature: GZ8MTXP02GQZCA.51.81.H04.1.454.CMB.2.raw
  modified_base (425)..(425): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccggccaggcccctgtgttggtgatgtaataaagacactgagacggccctgagggactccctgagcgtattctcgtggctccgaggtcaagggacacggtcactattcgccatcagtgagtccgagcgaggaggacgaggctagactattatgtacaatcaaanagactactagttagtacttagtacgttcgtacgaactcgaccgaacgtaacgtaccgtaccgtcgtacggacacgacccgaacgacccaaccctacgtacgtactacctccgtccg

SEQ ID NO: 434771 - DNA, 545 bp, Homo sapiens
  misc_feature: GZ8MTXP02GUWYT.51.81.H04.1.454.CMB.2.raw
  modified_base (284)..(284): a, c, t, g, unknown or other
  modified_base (335)..(335): a, c, t, g, unknown or other
  modified_base (360)..(360): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccacggcccctgtcgttggngtatgtaataaagacactggagaggccctgagggactccctgagcgattcnctggctcaggtcaggacacggtcanattggccagtcagtggatccgaggcgaggagacggaggctaggacttattattgtacaaatcaacagaccacgtattgtacttagtcgttcttacgaactcgacgacctaaggtcctaccggtccgtcgggtaccacgaccccgaaaggccccaaaccccgattccgacctacctcgtttccccg

SEQ ID NO: 434772 - DNA, 592 bp, Homo sapiens
  misc_feature: GZ8MTXP02JX3O7.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctcgtggagatgctattcgaccaaacgatatgtcttattcggtaccagcaagaacgccgggccacggcccctgtgttggtgatgtaataaacgacacgtgagacggccctcgagggtactcccgtagacgtcgtacttctcgtcggcctcgaggtcgacggggaccaacggtcactagttcggccatcgagtggacgtaccgaggacgaggacggacggaggtctagtaacttattagttgtactaatacaaacgtacaacctacgtagtttaggtaacttagttcgttacgtacgtaacgtcggaccgaccgtaaacgggtccaccgtccgtacggcaaccgacccgaacggcccaacccgtctcgtacctcccg

SEQ ID NO: 434773 - DNA, 513 bp, Homo sapiens
  misc_feature: GZ8MTXP02IJXUK.51.81.H04.1.454.CMB.2.raw
  modified_base (418)..(418): a, c, t, g, unknown or other
  modified_base (500)..(500): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtacagcagaagcgggccaggccccctgtcgttggtgatgtataaagacactgagagccctcagggatccctgagcgattctctggctcaggtcaggggacaacggtcacattggccatcagtggagtccaggcagaggacgaggctagactattattgtctaagtcaanagacactattggtactatgtacttcggactgacgactaaacggtcaccgtccgtaggtcaagcccgaacggacccaaacccnctacgtactaccg

SEQ ID NO: 434774 - DNA, 571 bp, Homo sapiens
  misc_feature: GZ8MTXP02ILLHP.51.81.H04.1.454.CMB.2.raw
  modified_base (235)..(235): a, c, t, g, unknown or other
  modified_base (299)..(299): a, c, t, g, unknown or other
  modified_base (427)..(427): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggcaggatcacctgctctggagatgcattgaccaaaccgntatgcttattggtaccagcagaagccggcacggccctgtgtggtgatgtataaagacactgagngcctgagggactccgtgagcgtattctcgtcggcctcgaggtcagggacacgggtcactattcggaccatcgaggtgacgtccgaggcaggaggacgaggctagacttattattagtactaatacaanagacaacctagttacggtacttagtcgtacgttcggaactcgacgaacgtaacggtccaaaccggttccgtacggggtaccaacggaccccgaaaacggcccccaaaaccccgtacgtacgtacctaccgttccgtttaccccg

SEQ ID NO: 434775 - DNA, 508 bp, Homo sapiens
  misc_feature: GZ8MTXP02JZ0EL.51.81.H04.1.454.CMB.2.raw
  modified_base (235)..(235): a, c, t, g, unknown or other
  modified_base (410)..(410): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagagcggcaggccctgtgtggtgatgtataaagacactgagaggcctcgagggactccctgagcgattctcgtggctcgaggtcagggacacggtcacagttggccatcagtgagtccgaggcagaggacgaggctagactattatgtacaatcaanagacacattcggtattatgtcttgaactgacgacaaggtccaccgtctcgggtaccacgacccaaggccccaaccctacgtcgacctactcttacccg

SEQ ID NO: 434776 - DNA, 612 bp, Homo sapiens
  misc_feature: GZ8MTXP02I1YMN.51.81.H04.1.454.CMB.2.raw
  modified_base (236)..(236): a, c, t, g, unknown or other
  modified_base (286)..(286): a, c, t, g, unknown or other
  modified_base (305)..(305): a, c, t, g, unknown or other
  modified_base (410)..(410): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagagccggcaggcccctgtgtggtgatgtanaaagcactgagaggccctnagggatcctgagcgattctctggctcagtcaggacacggtcacattgccatcagtgagtccaggcagaggacgagggctgaactattattagtaccaaatacaanacgaacaaccctaagttggtactttaagtcgttcgtttacgggaacttcggaccgtaaccgtaaaacggggttcctaaacccgggttccgtttacgggggtaccctaaccggggtaaccccccgtaaaacgggggtacccccccaaaaccccctaaaccgttccgggtaaacccctaacccgtttacccttttacccccggg

SEQ ID NO: 434777 - DNA, 505 bp, Homo sapiens
  misc_feature: GZ8MTXP02JL1DV.51.81.H04.1.454.CMB.2.raw
  modified_base (317)..(317): a, c, t, g, unknown or other
  modified_base (328)..(328): a, c, t, g, unknown or other
  modified_base (414)..(414): a, c, t, g, unknown or other
  modified_base (430)..(430): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccgggccaggccctgtgttggtgatgataaagacatgagacggccctgagggactccngagcgtattcnccgtggctccgaggtcaggggacacggtcactagttgccatcagtgacgtccaggcaggagacgagctgatattatgacaatcaanagacacattgtattangtcttacgatgacacgaagtccacgtcgtcgggtcacgaccgaacgccctaaaccccgctcgtaccactctcccg

SEQ ID NO: 434778 - DNA, 677 bp, Homo sapiens
  misc_feature: GZ8MTXP02FTWI8.51.81.H04.1.454.CMB.2.raw
  modified_base (239)..(239): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgctattcgaccaaaccgntatgtacttatggtaccagcagaacgccggccacggcccctgtgttggtgatgtaataaagacactgagacgccctgagggctcccgtgacgcgtattctccgtcggcctaccgaggtcgaacggggaacacgggtcaacgtagttcggacctagtacgaggtaggacgtcccgaggacgaagggaacggacggaggtcgtagtacttaagttagttagtaactaaatacaaacgacgaacctaaccgtagtttacggttaactttagttacgttaccgttacggtaacgttcggaaccggtaaaccgtaacggttacccgtaacccggttccggttacggggtaacccacccggaaacccccggaaacccggaacccccaaaacccccgttacggttacccgttaacccgtaacccgtttcccttttaaccccccgg

SEQ ID NO: 434779 - DNA, 550 bp, Homo sapiens
  misc_feature: GZ8MTXP02F3JX8.51.81.H04.1.454.CMB.2.raw
  modified_base (216)..(216): a, c, t, g, unknown or other
  modified_base (233)..(233): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccacctcggtgtcagtgtcccaggacagacggccaggatcacctgctctgganatgcattgccaaaccgntatgcttattggtaccagcagaagccggcaggcccctgtgttggtgatgtaataaagacacgtgagacggccctgagggactcccgtgacgcgtattctccgtggcctacgaggtcagggacacggtcaactattcgcctagtcacgtggactccgaggcaggaggacgaggtctgtacttattattgtacaatcaaacgagaaccactatttacggtactttagtacgtcgtttacgaactcgaccgactaggtcctaccgtcgtcgggtaccacggacccaacggacccaaccccagtcgtaccacttcttcccg

SEQ ID NO: 434780 - DNA, 506 bp, Homo sapiens
  misc_feature: GZ8MTXP02G3SZF.51.81.H04.1.454.CMB.2.raw
  modified_base (309)..(309): a, c, t, g, unknown or other
  modified_base (354)..(354): a, c, t, g, unknown or other
  modified_base (412)..(412): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnaggggatccctgagcgattctcctggctcaggtcaggacacggtnacattgccatcagtgagtccgaggcaggaggacgaggctgactatattgtcaatcaanagacaccattggtacttatgtcttacgaactgcgacaggtcaccgtctcgggtcacgtacccaagacccaacccactcgtaccactcgtacccg

SEQ ID NO: 434781 - DNA, 527 bp, Homo sapiens
  misc_feature: GZ8MTXP02HS4R7.51.81.H04.1.454.CMB.2.raw
  modified_base (306)..(306): a, c, t, g, unknown or other
  modified_base (326)..(326): a, c, t, g, unknown or other
  modified_base (354)..(354): a, c, t, g, unknown or other
  modified_base (378)..(378): a, c, t, g, unknown or other
  modified_base (407)..(407): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccggccaggcccctgtgttggtgatgtataaagacactgagagccctnagggatccctgagcgattcnctggctcaggtcagggacacggtcaacnttggccatcagtgagtccagcagngacgagctgactattatgtacaatcaaanagacacctagttaggtacttatgttacttacggaactgaccgaacgaaggtccaccgtcgtcgggtaccacgccccgaaacggccccaaaccccgctacgtaccaaccttacgttccccg

SEQ ID NO: 434782 - DNA, 485 bp, Homo sapiens
  misc_feature: GZ8MTXP02JC2GI.51.81.H04.1.454.CMB.2.raw
  modified_base (379)..(379): a, c, t, g, unknown or other
  modified_base (396)..(396): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaacccatattcttattggtaccagcagaagccaggccaggcccctgtgttgtgatatataaagacactgagagcttcagggatccctgagcgattctctggctccacctcaggacatggtcacattgaccatcagtgagtccaggcagaancgaggctgacttattcngtcaatcttcagacatcagtgtacttatgtcttacgaactgggacaacggtcaccgtcagtcagcccgaagccaacccatcgtcactcc

SEQ ID NO: 434783 - DNA, 497 bp, Homo sapiens
  misc_feature: GZ8MTXP02JMLL0.51.81.H04.1.454.CMB.2.raw
  modified_base (334)..(334): a, c, t, g, unknown or other
  modified_base (486)..(486): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtaataaagacactgagaggccctcgagggactccctgagcgattcnctggctccaggtcaggggacacggtcacatggccatcagtggagtccaggcagaggacgaggctgacttattattgtcaatcaacagacaccattggtacttatgtctcggaactgcgacagtcacgtctggcaagcccaaggcccaacccnctcgtactacc

SEQ ID NO: 434784 - DNA, 639 bp, Homo sapiens
  misc_feature: GZ8MTXP02H3J02.51.81.H04.1.454.CMB.2.raw
  modified_base (236)..(236): a, c, t, g, unknown or other
  modified_base (323)..(323): a, c, t, g, unknown or other
  modified_base (333)..(333): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaacgccggccacggccctgtgttggtgatgtaataaagacactgagcggccctagagggactccgngagcgattcncgtgcctacgaggtcagggtacacggtcactagttcgactatcgagtggactccgaggcaggagtacggaggctaggtacttagttattacgtactaaacttacaaaacgagtaacctaaccgtaagttttacgggtaacctttaagtcgtttaccgtttaacgggaaacgttacggaaccgtaaaccggtaaacgggttacctaaaccccgggttccgtacgggggttaccaaccggaccgaaaaccgaaaccgggaacccccaaaaccccctacgttacccggtacctaaacccgtttcccccg

SEQ ID NO: 434785 - DNA, 571 bp, Homo sapiens
  misc_feature: GZ8MTXP02GIHAO.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggcaggcccctgtgttggtgatgtataaagacactgagaggccctcgagggactcccgtgagcgattctctgctcgaggtcagggacacggtcacagttggccatcgagtggacgtccaggcaggaggacgaggctgactattattgtacaaatcaaacagaaccaacctattagggtaactttagtacgttcgttacggaaacttggaccgtaaccgtaaggtccctaaccgtccgtacgggttaccgacgaccccgaaacggcccccaaaaccccgtacgttaccgtcctaaccgttcctttccccgg

SEQ ID NO: 434786 - DNA, 784 bp, Homo sapiens
  misc_feature: GZ8MTXP02GJEAP.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagattgactagttacgaacccaaacgtatagtgttactttagttacggtaaccagacgaaggaacgggccccgggaccgaccgggtccccgttggttggttgggtagtagttaggtaaaagtaaaacgacctacgtaggaacggaccggtaccccgtacggaacggggtacccttacccggttaggaaccggtacgttaaccgttttccgttacccggttcgggtaccccgttaacccgggtaacgggttaccggaaaaccggggaaaccgtaaccggggttaccaaacgttaacggttccggaccctaagttaccggagggtacggtaccgtaccgaggacgaagggacggaaacggcggtctagtaactttaagttacgttacgtaactaaactacaaacgaacgtaacctaaccgttaagtttacggttaactttagtacgtttaccgtaacggtaacgttcgaaccgtaaaccggtacgttacccgaccggttccgtacgggtaccaccggaccgaaaccggacccctaaaccgtctacgtacctaccgttcgttacccccg

SEQ ID NO: 434787 - DNA, 620 bp, Homo sapiens
  misc_feature: GZ8MTXP02F9DTR.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttatggtaccagcagaagccggccaggccctgtgtggtgatgtaataaagacacgtagagacggccctagaagggactcccgtggaacgcgtactttcctccgtgggccctaccgagggttccgaacggggaacctaccggggtcaacgtagtttcgggaccctaatcgtaaggtcggacgtcccgaggacgaaggaacgggacgaggactagtacttattagttagacaaatacaaagagtaacacctagttcggttaacttagttcgttcgttacggaactcgacgaaaccgtaacggtcctaaccggttccgtacgggtaccaacgaccccgaaacggcccccgaaaccctacgtcgtaccaccttcgttccccg

SEQ ID NO: 434788 - DNA, 596 bp, Homo sapiens
  misc_feature: GZ8MTXP02GR3K9.51.81.H04.1.454.CMB.2.raw
  modified_base (238)..(238): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggcaggcccctgtgttggtgatgtataaagacactgagacggccctcgagggactcccgtgacgcgacttctcgtggcctccgaggttcgacggggacaacgggtcactagttcggccagtcaggtggacgtcgaggcaggacggacgaggctagaacttattattagtactaaatacgaacaacgaaccaactaagtttacggtaactttagtacgtttcgttacggtaaacgtcggaccgtaaaccgtaaacgggtcctaacccggtccgtacggggttaccaacgaccccgaaacggaccccaaacccccacttccggtacctacccg

SEQ ID NO: 434789 - DNA, 532 bp, Homo sapiens
  misc_feature: GZ8MTXP02F8BPW.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgaccaggatcacctgctctggagatgcattgccaaaccgatatgcttatggtacagcagaagccggcaggcccctgtgtggtgatgtataaagacactgagaggccctgagggactcccgtgagcgattctccgtggcctccgaggtcgagggacacggtcacattgccatcagtgagtccgaggcaggaggacgaggctgactattattgtacaaatacaacagaacacctaattggtacttagtcgtacttacggaactgacgacaaaggtccaaccgtccgtcgggtaccacgacccgaacggcccaaaccccgactcgtaccacctcttcccg

SEQ ID NO: 434790 - DNA, 627 bp, Homo sapiens
  misc_feature: GZ8MTXP02HNCHT.51.81.H04.1.454.CMB.2.raw
  modified_base (606)..(606): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaaacgatatgtacttattggtaccagcagaacgccggccacggccctgtgtggtgatagtaataaagacacgtgagcgccctcgagggactcccgtagacgtcgtattcgtccgtcggcctccgaggttacgaacggggaaccaccggggtcaaacgtacgtttacgggaccctagtcgtaaggtcgggacgtacccggaaggccggaaggaagggacggacggggtactacgtaacgttattagttaggtactaaactacgaaacagaaccacctagttacggtactttagtacgttcttacggaacttcgaccgacgtaacgtccctaaccggtctcggggtaccacgacccgaacggacccaaaccccntaccgtcaccgttcgtacccg

SEQ ID NO: 434791 - DNA, 521 bp, Homo sapiens
  misc_feature: GZ8MTXP02J13I3.51.81.H04.1.454.CMB.2.raw
  modified_base (236)..(236): a, c, t, g, unknown or other
  modified_base (400)..(400): a, c, t, g, unknown or other
  modified_base (424)..(424): a, c, t, g, unknown or other
  modified_base (444)..(444): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggccaggcccctgtgttggtgatgtataaagacactgagacggccctcgagggactccctggacgcgattctccgtggctccgaggtcgacgggacacggtcactattggccatcagtgagtccgaggcagaggacgngcgtgacttatatgtacaatcaanagactacattgtacttagtntcgttagaactgcgacgaggtccaccgtcgtcgccgacgacccaacggacccaacccgactcgacctactcttcccg

SEQ ID NO: 434792 - DNA, 519 bp, Homo sapiens
  misc_feature: GZ8MTXP02FJDKP.51.81.H04.1.454.CMB.2.raw
  modified_base (179)..(179): a, c, t, g, unknown or other
  modified_base (416)..(416): a, c, t, g, unknown or other
  modified_base (423)..(423): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtntccccaggacagacgccaggatcacctgctctggagatgcattgcccaaaccgatatgcttatggtaccagcagaagccggcaggcccctgtgtggtgatgtataaagacactgagaggcccctcgagggactccccgtgagcgattctcctgggctccgaggtcaggggacacgtcacattgccatcagtgagtccaggcagaggacgaggctagactattattgtcaatcaaacngacaccnttggtacttagtgtcttacggaactggcacccaaaggtccacccgtccgtcgggtccacgcccaaaggccccaaaccccactcgtcacctctcccg

SEQ ID NO: 434793 - DNA, 685 bp, Homo sapiens
  misc_feature: GZ8MTXP02G2DO8.51.81.H04.1.454.CMB.2.raw
  modified_base (239)..(239): a, c, t, g, unknown or other
  modified_base (286)..(286): a, c, t, g, unknown or other
  modified_base (293)..(293): a, c, t, g, unknown or other
  modified_base (322)..(322): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaaccgntatgtcttagtgtaccagcagaacgccggccacggccctgtgttggnatgtaanaaagcactgacgacgcctacgagggtacncctgagcgtatctcgtcgctcgaggtcgaggacacgggtacactagttcgaccattacgaggtacggacgtaccggagacgaggaaaggaccggaggtacctagtaacttaagtttacgttacggtaactaaacgttaacgaaaacgtaaccgtaaaccctaaccgttaagtttacgggttaaaccctttaagtttacggttacccggttaacggtaaaaccgtccgggtaaccggaaaacccggttaacggttacccgtaacccggttccggttacggggtacctacccggaaaccccgtaaccggaaccccctaaaccccgtaccggtccgtaacccgtacccgttacgtttaaccccccg

SEQ ID NO: 434794 - DNA, 530 bp, Homo sapiens
  misc_feature: GZ8MTXP02HXZGD.51.81.H04.1.454.CMB.2.raw
  modified_base (235)..(235): a, c, t, g, unknown or other
  modified_base (308)..(308): a, c, t, g, unknown or other
  modified_base (410)..(410): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagaggccctnagggatccctgagcgattctctggctcaggtcagggacacggtcacattggccatcagtgagtccgagcagaggacgaggctgactatattgtcaatcaaanagacacctagttggtactttagtgttacttacggaaacttggaccgacctaaaggtccaaccggttcctcggggtaccacgcccaaacggcccaaaccccgctacgtccacttcttcccg

SEQ ID NO: 434795 - DNA, 559 bp, Homo sapiens
  misc_feature: GZ8MTXP02IRM91.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagaggccctcgagggactccctgacgcgattctctggctccgaggtcagggacacgggtcaactagtgccatcagtgagtccgaggcaggaggacgtagggctagaacgtattagttgtacaatacaacagtacaacctagttaggtaactttatgttacttacggaacttgacgaacctaagggtacctaaccggtcgttcggggaccaacggaccccaaacggccccaaaacccccactacgtacctaccttccgtccg

SEQ ID NO: 434796 - DNA, 554 bp, Homo sapiens
  misc_feature: GZ8MTXP02JUO0G.51.81.H04.1.454.CMB.2.raw
  modified_base (234)..(234): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagagccggccaggcccctgtgtggtgatgtataaagacactgagaggccctcgagggactcccgtgagcgattctccgtggctccgaggtcgagggacacgggtcacagttcggccagtcagtggacgtccaggcaggaggacgaggctgactattattgtacaatacaacagaacacctattaggtacttagtgttacttacggaactcgaccgaaccgtaacggtcccgtaaccgttccgtcgggtaccgaccggacccgaacggaccccaaccccgactacgtcctacctcttccccgg

SEQ ID NO: 434797 - DNA, 514 bp, Homo sapiens
  misc_feature: GZ8MTXP02FMFL0.51.81.H04.1.454.CMB.2.raw
  modified_base (235)..(235): a, c, t, g, unknown or other
  modified_base (406)..(406): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtacagcagagccggcaggccctgtgtggtgatgtataaagacactgagaggccctcgagggatcccgtgagcgattctcctggcctcgaggtcagggacacggtcacattgccatcagtgagtccagcagagacgagctgactattattgtacaatcaanagacacctattggtacttatgtcttagactgacacaggtcaccgtcgtcgggtccacggacccaacggaccccaaaccccgtacgtacgtacctacctccgttacccg

SEQ ID NO: 434798 - DNA, 512 bp, Homo sapiens
  misc_feature: GZ8MTXP02H3GXT.51.81.H04.1.454.CMB.2.raw
  modified_base (218)..(218): a, c, t, g, unknown or other
  modified_base (236)..(236): a, c, t, g, unknown or other
  modified_base (305)..(305): a, c, t, g, unknown or other
  modified_base (357)..(357): a, c, t, g, unknown or other
  modified_base (372)..(372): a, c, t, g, unknown or other
  modified_base (380)..(380): a, c, t, g, unknown or other
  modified_base (387)..(388): a, c, t, g, unknown or other
  modified_base (395)..(395): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgntatgcttattggtaccagcagaagccggccaggcccctgtgttggtgatgtaataaagacactggaagnggccctgagggactcctgagcgattctctggcctcaggtcaggacacggcangttgccatcagtgancagcaggngagaggnngactatntgcaaatcaaacagaccactattaggtacttatgttcttagaacgttgaccgtaacgaaggtcaaccgtcgttgggcaacgcccaacggcccaaaacccgctgtaccacttctcccg

SEQ ID NO: 434799 - DNA, 590 bp, Homo sapiens
  misc_feature: GZ8MTXP02IUQYS.51.81.H04.1.454.CMB.2.raw
  modified_base (235)..(235): a, c, t, g, unknown or other
  modified_base (317)..(317): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtgtggtgatgtataaagacactgagaggccctcgagggctcccngagcgattctcctgctcaggtcagggacacgggtcacagttcgccagtcagtgggagtccaggcaggaaggacgagggctagtaactattagttagtactaaatacaaacaacgactaacctaagttggttaacttagtacgttacgttacggtaaacttcggaaccgtaaccgtaaacgggttccaacccggttccgtacggggtaccaaccggaccccgaaacgggaccccaaacccccgtacgtcgtaccctaccgttccgtttccccgg

SEQ ID NO: 434800 - DNA, 599 bp, Homo sapiens
  misc_feature: GZ8MTXP02HHY61.51.81.H04.1.454.CMB.2.raw
  modified_base (239)..(239): a, c, t, g, unknown or other
  modified_base (464)..(464): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgtcttatggtaccagcagaacgccggccaggcccctgtgttggtgatgtaataaagacaactggaagacggccctcgagggactcccgtgacgcgtacttcgtcgtggcctaccgaggtcacgggacaacggtcactagttcggacctagtcgagtcggacgtacccgagggaccaggaacgggaccgagggcctagacttaagtttagttagtactaaaanacaacgacgactaacgtagttacgttacttagttcgtacgttacgtacgtacgaccgaaacgtacggtaccgtaccgtccgtacggaccgaaccgaacccgaaccggaccccaacccgtacgtaccgtactaccg

SEQ ID NO: 434801 - DNA, 537 bp, Homo sapiens
  misc_feature: GZ8MTXP02GAVX2.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagaggccctcgagggactcccgtgagcgattctcctggctcaggtcagggacacggtcactagttgccatcgagtggagtcccgaggacaggaggacgaggctgaactattattgtacaaatcaaacagtaaccacctaatttggtaactttatcgttcttacggaactgacgaccgaaggtcaccgtcgtcgggtacacgacccaaggccccaacccgactcgtaccactcttacccg

SEQ ID NO: 434802 - DNA, 585 bp, Homo sapiens
  misc_feature: GZ8MTXP02IQAFG.51.81.H04.1.454.CMB.2.raw
  modified_base (240)..(240): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgntatgtcttattggtaccagcagaagccgggccaggcccctgtgtggtgatgtataaagacactgagacggccctcgaggactcccgtgagcgtacttctctggctcgaggtcgaggggacaaaccgggtcacgtagttcgggacctatcgagtggtacgtccgagggcaaggacggacggaggctagacttattacttagtactaatacaacaagaaccaccgtagtttacggtaactttaagttcgttacttaccggtaaacgtgtacccgaacgtaaacggtacctaaccgtccgttggtaccaacgaccccgaacggacccaaacccgacttcgacctaccg

SEQ ID NO: 434803 - DNA, 621 bp, Homo sapiens
  misc_feature: GZ8MTXP02F19ML.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctctatgagctgacacagccaccctcggtgtcagtcgtccccaggacagacggccaggatcacctgctctggagatgcattgaccaaacgntatgcttatgtacagcagagccggcacggccctgtgtggtgatgtaataaagacactgagacggccctcgagggactcccgtgacgcgacttctcgtcgctcgaggtcgaacgggactacggtcactagttcgacctatacgagtaggacgtccgaaggcaaggacgggaacgagggtacctaggtaacttaattagttacgtactaaacttacaaacaacgaaccaaccgtaagtttacggtaacttagttacgttacgttacggtaacgtcgaaccgtaaccgtaaaggtccgtaacccggtcggttacgggtaaccaaccggaccccgaaaaccgggaccccaaaaccccgtacgtaccgtaccctacttcccgtttaccccg

SEQ ID NO: 434804 - DNA, 568 bp, Homo sapiens
  misc_feature: GZ8MTXP02JOKXH.51.81.H04.1.454.CMB.2.raw
  modified_base (236)..(236): a, c, t, g, unknown or other
  modified_base (280)..(280): a, c, t, g, unknown or other
  modified_base (308)..(308): a, c, t, g, unknown or other
  modified_base (334)..(334): a, c, t, g, unknown or other
  modified_base (414)..(414): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggcacggccctgtgtggngatgtataaagacacgtgagcggccctnagggactccgtgacgcgattctccgnggcctccgaggtcgaagggacacgggtccactagttcggacagtcaggtacgggactcccgaggcgaggacgggaacggnggctagtattattattagtactaatacaacgacgtaaccaacgtagtttacgttaactttagtacgttacgttacggactacggaccgtacgtaacggtccgtaccggtcgtcggaccacgacccaacgacccaccgtctcgtactctcctccg

SEQ ID NO: 434805 - DNA, 546 bp, Homo sapiens
  misc_feature: GZ8MTXP02JHCP4.51.81.H04.1.454.CMB.2.raw
  modified_base (234)..(234): a, c, t, g, unknown or other
  modified_base (269)..(269): a, c, t, g, unknown or other
  modified_base (273)..(273): a, c, t, g, unknown or other
  modified_base (439)..(439): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgacaaacgntatgcttattggtacagcagaagcggcagccctgngtgngatgtataaagacacgtgagacggccctacgagggactcccgtgaagcgattctcgtgctacgagtcgaaggacacgggtcactaacgttggccagtacgagtaggactacccgaggacaaggtaaggacgaggtcctagaacttattattgtacaaatcaaaganacaactattaggtacttagtgtcgttacgaactgacgaaccgtaaggtcaaccggtccttacgggaccacgaccgaacggcccaaacccactcgtctactctacccg

SEQ ID NO: 434806 - DNA, 747 bp, Homo sapiens
  misc_feature: GZ8MTXP02H53EJ.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaacgccggcaggcccctgtgttggtgatgtaataaagacacgtagagacggcccctcgaaggggactcccgtaggagcgatttcctccgtgggccttccgaagggttccgaaggggtacccaacggggttccaactaacggtttcgggaccctaacgtaccgtaagggttacgggacggttaccccgaaggggaccgaaacggggtaaggggaacccggtaaaggggccgttaagggaaacctttatttaaagtttacggttaacaaaacgttacaaaaccgtaacggaacctaaccctaaacgttttagggttaaaacccttttagtacggtttccgtttaacgggaaaaccgttacggaacccgaaaccgtaaaacggggtttcccaaacccgggtttccgtacgggggttaacccaccgggaacccctaaaacggggccccctaaaaaccgttccgtaaaccttccggtaacctaaccggtttccccg

SEQ ID NO: 434807 - DNA, 628 bp, Homo sapiens
  misc_feature: GZ8MTXP02GWLX3.51.81.H04.1.454.CMB.2.raw
  modified_base (237)..(237): a, c, t, g, unknown or other
  modified_base (253)..(253): a, c, t, g, unknown or other
  modified_base (276)..(276): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttattgtaccngcagagcggcagccctgtgtggnatgtataaagacacgtgagacggccctacgacgggactcccgtgagtcgtattctccgtcggcctaccgaggtcgacgggaacgacgggtacacgtagttacggaccctagttcaggttcggacgtacccgaggacgaggaacgggacggaggtctacggattagttattacgtactaaatacaaacgacgaactaaccgtagtttaggtaactttagtacgttacgttaccggtaacgtacggtaccgtaaccgtaaacgggtccctaaccgggttccggttacgggtaccgaccggtacccgaaacggaccccaaccccgtacgtacgtacctaccttccgtttaccccg

SEQ ID NO: 434808 - DNA, 624 bp, Homo sapiens
  misc_feature: GZ8MTXP02G7041.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaccgatatgcttattggtaccagcagaagccggcacggcccctgtgtggtgatgtaataaagacacgtgagacggccctgagggactcccgtgacgtcgacttctcgtggcctcgaggttcagggggacctaaacgggtcacgtagttcggccatcgaggtggacgtccgaggccgaagggaggacggaacgggtctaggtaacttatttagttcgtactaaattaccaaacgtaagaaccctaacctagtttacggttaactttaagttcgttacgttcgggtaaaacttcggaccgtaaccgtaacggtcctaacccgttcgtacggggtacaaccggaccccgaacggtaccccaaaacccctcgttacggtacccttaacccg

SEQ ID NO: 434809 - DNA, 560 bp, Homo sapiens
  misc_feature: GZ8MTXP02FWRT0.51.81.H04.1.454.CMB.2.raw
  modified_base (236)..(236): a, c, t, g, unknown or other
  modified_base (440)..(440): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggcaggcccctgtgttggtgatgtaataaagacactgagaggccctcgagggactcccgtgagcgattctccgtggcctcgaggtcgaagggacacgggtcacgtagttcggacctatcgaggtggagtcccgaggacaaggaggacgtaggctagacttattattgtacaatacaanagacacctagttgtaacttatcgtcttacggaactcgacgaccgaaaggttccaaccgttcgtcggggtacacgtacccgaaacggaccccaaaccctactcgtacctcttccttacccg

SEQ ID NO: 434810 - DNA, 629 bp, Homo sapiens
  misc_feature: GZ8MTXP02IDOA4.51.81.H04.1.454.CMB.2.raw
  modified_base (235)..(235): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctgagatgcattgacaaacgntatgcttatggaccagcaagagccggcacggccctgtgtgtgatgtaataaagcatgagacggccctgaggactcccgtagacgcgtacttcgtcgtcggctaccgaggttacggacgggaactaaacgggtcaacgtagttcggaccctagtaccaggtggacgtccgaaggccgaaggaagggtaaccggaggtaccgttaggaaacctttaagtttagtttacggtaactaaaatacaaaacgtacgaacctaaacccgttaagttacggtttacttaagttcgttaaccgttacggtaacttacggaccgaaaccgtaaacggttccgaacccgttccgttaggacaaccggacccaacggaccccaaaacccgctaccgttactacccg

SEQ ID NO: 434811 - DNA, 603 bp, Homo sapiens
  misc_feature: GZ8MTXP02H2TYN.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtaataaagacactgagacggcctcgagggatccctgagcgattctctgctcgaggtcaggacacggtcaactagttgacctatcaaggtcggagtcccgaggcaaggaggacgaggctaggaacttattagtttagactaaatacaaacaagaccaacctaagttcggtaactttatgttactttacgggaaaacttcggaccgaaccgtaaacgggtcctaacccggttacccgttacggggtaccaacggaacccccgaaaacggggacccccaaaaaccccctacgtaccggtaccaaccgtttccttaccccg

SEQ ID NO: 434812 - DNA, 567 bp, Homo sapiens
  misc_feature: GZ8MTXP02I7R8A.51.81.H04.1.454.CMB.2.raw
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgacccaaacgntatgcttatggtaccagcagaagccggccacggcccctgtgtggtgatgtaataaagacactgagacgccctgagggactccgtgagcgattctctggctcgaggtcgagggacaaacggtcacgtagttcggaccagtcgagtggtacgaccgaggacgagacgggacgagggctaggacttagttattgtacaatacaaacagactaccgatttagtaacttatacgtcgtacgtaaacgtcgcgtaaacctaaacgggtcctaccggtccgtggggtaccaacgacccgaaacggcccaaaaccccctataccggtactaacccg

SEQ ID NO: 434813 - DNA, 602 bp, Homo sapiens
  misc_feature: GZ8MTXP02INVPV.51.81.H04.1.454.CMB.2.raw
  modified_base (222)..(222): a, c, t, g, unknown or other
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttatggtaccagcagaagccgggccaggcccctgtgttggtgatgtaataaagcaactgagaggccctcgagggctccctaggacgcgtactttctcgtcggctccgaggttacacgggggaacctaaacgggtccaacgtacgtttcggacctataccgaggtcggaacgtccgaggacgaggagggacgaggctaggaacttatttagttgtactaaatacaaacgaacgactaaccctagtttacggtaactttaattgttacgttacggtaactcggaccgaccaaacggtccacccgttaccgtcggggtaccaacgacccgaacggaccccaaacccacgtcgtactacccg

SEQ ID NO: 434814 - DNA, 583 bp, Homo sapiens
  misc_feature: GZ8MTXP02FMPN0.51.81.H04.1.454.CMB.2.raw
  modified_base (286)..(286): a, c, t, g, unknown or other
  modified_base (331)..(331): a, c, t, g, unknown or other
  modified_base (443)..(443): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgacccaaaccgatatgtcttattggtaccagcagaagccggccacggccctgtgttggtnatgtaataaagacactgagacggccctgagggactcccgtgacgngacttctccgtggcctccgagggtcgaggggacacggtcaactagttcgaccatcgagtggacgtaccgaggcgaggaggacgaggctagacttattattgtacaatacaanagacactagttagtacttagtgttactacggaactcgtaccgaaccgtacggtccaacccggttccgttacggggacaccggaccccgaaacggcccctaaaacccccgacgttccgtacctaccgttccgtttccccgg

SEQ ID NO: 434815 - DNA, 582 bp, Homo sapiens
  misc_feature: GZ8MTXP02I4UEY.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgttatatgcttattggtaccagcagaagccggccaggcccctgtgtggtgatgtataaagacactgagacggcccgtggggactcccgtggagcgtattcctctcggcctccgaggtcgagggacaacggtcacagttcggccatcgagtgggactccgaggcaagggcggtacgaggcctaggtacttatttagttgtacaaattcaaacgtagaaccctaccgtaagttttacggtaactttagtcggttacttacggaaccttgaccgtaccgagttaccgaccgtcgtaggtccacgcccgaacggcccaaccccgcttcgcctacgtccttaccgttaccccc

SEQ ID NO: 434816 - DNA, 639 bp, Homo sapiens
  misc_feature: GZ8MTXP02F9LV7.51.81.H04.1.454.CMB.2.raw
  modified_base (380)..(380): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctggagatgcattcgaccaaaccgatatgcttattggtaccagcagaacgccgggccacggcccctggtgttggtgatgtaataaagcacgtgagacggccctcgagggactcccgtgacgcgtacttctctcggcctccgaggtcgagggacaacggtcacgtnttcggcctagtcgaggtcggacgtccgaaggcgaagggaacgggacggacggtacgtacgtaacgttatttacgttagtactaaataccaaaacgtaacgaacctaaccgtaagtttcgggttaaacctttagttaccgtttacgttacggaaactttcggaccgtaaaccgtaaacgggtccgtaacccggttccggtcggtaccgaacgaacccccgaacggaccccctaaaccccacgttacgtaccctaacccgg

SEQ ID NO: 434817 - DNA, 678 bp, Homo sapiens
  misc_feature: GZ8MTXP02ISGC7.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgtcttagttcggtaccagacagaacgccggccacggcccctgtcggttggtgagtgtaataaagacactggaagcggccctacgagggactccgtgagtcggtatttccgtccgtcggtcctccgaggtacgacgggacacgggtcaacgtagttacgccatacgaggtggaactccgaggacgaggaagggacgaggacgtagaacttattagttacgtaacaaacgttaacaaacgtaacgaacctaacccgttagtttaacgggttaacctttaagttcggtttaccgttaaccgggtaaacgtcggtacccgtaaaaccggtaaacggttcccgtaaacccggttccggttacggggtacccaaccggacccgaaacccggaacccccaacccccgtaacgttccgtacctacccgtttccgtttacccccgg

SEQ ID NO: 434818 - DNA, 577 bp, Homo sapiens
  misc_feature: GZ8MTXP02IAT99.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccggccaggcccctgtgttggtgatgtaataaagacactgagacggccctcgagggactcccgtgacgcgattctccgtggcctccgaggtcgaggggacacggtcactagttcggaccatcaggtaggagtcccgaaggcaggacggaacggaggtctaggaacttattagttagtacaaattacaaacagaaccacccgtaagttacggttaactttagtcgttacttacggaacttcgacggacctaacggtcaccgtcggtacggacacgacccgaacgacccaaacccacgtcgtaccaaccttccttacccg

SEQ ID NO: 434819 - DNA, 607 bp, Homo sapiens
  misc_feature: GZ8MTXP02ISGR9.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaagccgggcacggcccctgtgtggtgatgtaataaagacactgagacggccctacgaggactccctggacgtcgtacttctcgtcggcctcgaggtacgaggggaacaacgggtccactagttcgggacctatcgagtggacgtccgaggcgaggaggacgaggctagacttagtttattgtaactaagtaccaaacgacgacctaacctagtttcggttaaactttagttcgttaccgttacggtaactggaccgaaccgtaacgggtacctacccggtccggttgggtaccctaacggaccccgaacgggtacccccaaaccccgtacgtccgtaccttacccg

SEQ ID NO: 434820 - DNA, 557 bp, Homo sapiens
  misc_feature: GZ8MTXP02HLY5E.51.81.H04.1.454.CMB.2.raw
  modified_base (278)..(278): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagagccggcaggccctgtgtggngatgtataaagacactgagaggcctgagggactccctgagcgattctcgtggctccgaggtcagggacacggtcaactagttggccatcgagtggagtccgaggacaggaggacgaggctagaacttattaattgtactaaatacaaacagaaccaacctagtttaggtaacttagtagttcgttacggaactcgaccgaaccgtaaggtccaaccggtcgtcgggtaccacgacccgaaacggcccaaacccgacgtcgtaccctacgttccttcccg

SEQ ID NO: 434821 - DNA, 516 bp, Homo sapiens
  misc_feature: GZ8MTXP02JJFFJ.51.81.H04.1.454.CMB.2.raw
  modified_base (235)..(235): a, c, t, g, unknown or other
  modified_base (307)..(307): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagagccctnagggctccctgagcgattctcctggctccaggtcaagggacacgggtcacagttcggccagtcagtggagtccaggcaggaggacgaggctagactattattagtacaatacaacagacaccagtttggacttatgtcttacggaatgcgacacggtcaccgtctcgggtccagacccaaggcccaaacccgctacgcactcttacccg

SEQ ID NO: 434822 - DNA, 529 bp, Homo sapiens
  misc_feature: GZ8MTXP02GB30Y.51.81.H04.1.454.CMB.2.raw
  modified_base (309)..(309): a, c, t, g, unknown or other
  modified_base (393)..(393): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcagaagccggcacggcccctgtgttggtgatgtataaagacactgagaggccctnagggactccctgagcgattctctggctcgaggtcagggacacggtcaacattcggcatcagtggagtccgaggcaggaggacgnggctagactattatgtacaaatcaacagacaccaagttgaactttatgtcttacgaatcgacgtaccgaaggtccaaccgtccgtagggtaccacgacccgaaagccccaaaccctacgtcgtaccacttctcccg

SEQ ID NO: 434823 - DNA, 623 bp, Homo sapiens
  misc_feature: GZ8MTXP02IH0VF.51.81.H04.1.454.CMB.2.raw
  modified_base (220)..(220): a, c, t, g, unknown or other
  modified_base (340)..(340): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctgganatgctattcgccaaaccgattatgacttattggtaccagcagaagccggccaggccctgtcgtggtgatgtaataaagacacgtagagaggccctcgagggactcccgtgacgcgattcncctaggcctacgaggtcgacgggacacgggtcaacgtagttcgacctagtacgtaggtcgggacgtcccgaaggcaggaacgggtacggacggtactaggaacctttaatttacgtttaggtacctaaaagttaccaaacgtaacggaacctaaccgttagtttacgggtttaactttagtacgtttacgttacggtaacgttcgacgtacgaaacggtcctaaccgtccgtcgggtacacgacccgaacggacccaacccgctacgcctacctccgttcccg

SEQ ID NO: 434824 - DNA, 610 bp, Homo sapiens
  misc_feature: GZ8MTXP02H3Z84.51.81.H04.1.454.CMB.2.raw
  modified_base (282)..(282): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagagccggccaacgccctgtgttggngatgtataaagacactgagagccctgagggctccctgagcgattctctggctcgaggtcgacgggacacgggtcactagttcgccatcgagtggagtccgaggcaggaggacgaggctgaacttattattgtacaaatcaaacaggaacctaacctagtttacggtaactttagttacggttccgttacgggaaaacttcggaacccgtaaacgaaacgggttcccaacccgggttccgttacgggggtacccaaccggacccccggaaaacggacccccgtaaaacccccgtcgttacggtacccaaccgtttcccgtttacccccg

SEQ ID NO: 434825 - DNA, 576 bp, Homo sapiens
  misc_feature: GZ8MTXP02IT5U2.51.81.H04.1.454.CMB.2.raw
  modified_base (236)..(236): a, c, t, g, unknown or other
  modified_base (291)..(291): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggccaggcccctgtcgttggtgatgtaanaaagacactgagaggccctcgagggctccctgagcgattctctgctccgaggtcagggacacgggtcactagttgccatcgagtgggacgtccaggcaggagacgaggctgacttattattagtacaaatcaaacagacacctagtttaggtactttagtacgttcttacggaactcggacgtaaccgtaacggtaccgtaacccgttcgtcggggttaccaccggaccccgaaacggaccccctaaaaccccgacgttacgtaccaaccctttcgtttaccccg

SEQ ID NO: 434826 - DNA, 609 bp, Homo sapiens
  misc_feature: GZ8MTXP02JTG1T.51.81.H04.1.454.CMB.2.raw
  modified_base (236)..(236): a, c, t, g, unknown or other
  modified_base (401)..(401): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggccaggcccctgtgttggtgatgtaataaagacactgagaggccctacgaggggctcccgtgacgcgtattctcgtcgctcgaggtcagggacacgggtcacgtattggccatcgagtggacgtcgaggcaggagagngctgactattatgtacaaacgtcaaacagaacctaacctaagtttacgggttaactttaggttcgtttaccgttaacggtaaaccttaggacccgaacccggtaaacgggtacccgtaacccggttccggttacggggtacccaaccgaccccgaaaacgggtcccccaaaacccccgtacgtccgttacccacctttcgtttacccg

SEQ ID NO: 434827 - DNA, 661 bp, Homo sapiens
  misc_feature: GZ8MTXP02IQS6S.51.81.H04.1.454.CMB.2.raw
  modified_base (299)..(299): a, c, t, g, unknown or other
  modified_base (334)..(334): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattcgaccaaaccgatatgtctttattcggtaccagcaaggaacgccggccacggcccctgtggttggtgatgtaanaaagacacgtgagcggccctacgagggactcccgngacgcgtattctccgtggcctccgaggtccgaacggggacgaccgggtcaacgtagttcggacctagtcgtaagggttcgggaacgtcccgaagggaccgaagggaacggggaccggagggtccgttaggtaaacttatttatttagtaacaaattacaaacgacgtacctaaccgttagtttaggttaactttagttacgttacgttacggaaaacgtgaacccggtacctaacgggtcccgtaaccggttccgtacgggtacccaccgtacccgaaacggtacccccaacccgtacgtaccgtaccgtaccgttcctttaccccg

SEQ ID NO: 434828 - DNA, 532 bp, Homo sapiens
  misc_feature: GZ8MTXP02FLZES.51.81.H04.1.454.CMB.2.raw
  modified_base (324)..(324): a, c, t, g, unknown or other
  modified_base (427)..(427): a, c, t, g, unknown or other
  modified_base (449)..(449): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtacagcagagcggcaggcccctgtgtggtgatgtataaagacactgagaggccctcgagggatcccgtggagcgattcncctggcctcaggtcagggacaccgggtcacgtagttggacccagtcgagtgggacgtacccagggcaggaggacgagggctgactattattgtacaatacaanacgaacacctagttagtacttntgtcttacggaactgcgacaaggtccaccgtcgtggtccacgacccgaacggccctaaaccccgctacgtactacctcgtccg

SEQ ID NO: 434829 - DNA, 619 bp, Homo sapiens
  misc_feature: GZ8MTXP02H7MQ7.51.81.H04.1.454.CMB.2.raw
  modified_base (406)..(406): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccgggccacggcccctgtgttggtgatgtaataaagacatgagacggccctagagggactcccgtagacgcgtactctcgtcggcttccgagggttcgaggggacctaaacgggtcacgtagttcgggacctatccgtaggnggaacgtcccgagggccgaagggacgggaacggtaaggcgttagaacttaatttagttagtactaaatacaaacgacgaacaacctagttacggttaactttagtcgttacgttacggtaactcggtaccgaaacctaacgggtcctaacccgtccgtagggtaccaaccggacccaaacggaccccaaacccctacgtcgttacctaacccg

SEQ ID NO: 434830 - DNA, 526 bp, Homo sapiens
  misc_feature: GZ8MTXP02HLGQ4.51.81.H04.1.454.CMB.2.raw
  modified_base (332)..(332): a, c, t, g, unknown or other
  modified_base (361)..(361): a, c, t, g, unknown or other
  modified_base (369)..(369): a, c, t, g, unknown or other
  modified_base (416)..(416): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtaataaagacactgagacgccctgagggtactccgtgagcgattcncgtcggctccaggtcagggacacggtcanagtgccancgagtgatccgagcaggagacgaggctgactattatgacaatacaanagaccactattaggtacttagtgttacttacggaaatcgacgaacaacggtcaacccgtctcgggtacaacgaccccgaaggcccaaacccgtactcgcctactcctccg

SEQ ID NO: 434831 - DNA, 554 bp, Homo sapiens
  misc_feature: GZ8MTXP02GW9BV.51.81.H04.1.454.CMB.2.raw
  modified_base (218)..(218): a, c, t, g, unknown or other
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttattggtaccagcagaagccggccaggcccctgtgttggtgatgtaataaagacactgagacggccctagagggactcccgtgacgcgtattctccgtgcctcgaggtcgaggacacggtcactagttcgaccatcaggtggacgtcccgaggacaggaggacgacggctagtacgttattagttagtactaaatacaaacgacaaccactagttagtacttagtgtcgtacgactcgacgacgaaggtccaccgtcgtcggtacgacgacccgaaacggaccccaacccgactcgtacctacctcttccccg

SEQ ID NO: 434832 - DNA, 602 bp, Homo sapiens
  misc_feature: GZ8MTXP02FMLO1.51.81.H04.1.454.CMB.2.raw
  modified_base (218)..(218): a, c, t, g, unknown or other
  modified_base (235)..(235): a, c, t, g, unknown or other
  modified_base (277)..(277): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatggtacagcagacgccggcaggccctgtgttggnatgtaataaagacacgtgagacggtccctagagggtactcccgtagacgcgtacttctccgtggcctacgaggtcgaacgggacacggtcaacgtagttcggacctagtacgaggtaggacgtacccgaggcgaaggaggaccgaggctagaacttattacgttgtacaatacaaacgacgtaactacctagtttaggtactttagtcggttactttcggaacttcgtaccgacgtaaacggtcctacccggtacgtcggggtaaccaccgacccgaaacggtacccccaaacccgtaccgtcgtacctaccgttctttaccccg

SEQ ID NO: 434833 - DNA, 557 bp, Homo sapiens
  misc_feature: GZ8MTXP02FJL3N.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtaataaagacactgagacggccctcgagggactccctgacgcgtacttcctcgtggcctccgacggtcgacggggaccaacgggtcacagttcggccatcgagtggacgtccgaggcaggacggacgaggctagacttattattgtacaagtcaaacagaaccactagttacgtacttagtcgttcgtacggacttacgacgtaccgaaaggtccaccgtccgtacggtacaacgacccgaacggacccaacccacgtacgctaccg

SEQ ID NO: 434834 - DNA, 536 bp, Homo sapiens
  misc_feature: GZ8MTXP02FPKLA.51.81.H04.1.454.CMB.2.raw
  modified_base (236)..(236): a, c, t, g, unknown or other
  modified_base (277)..(277): a, c, t, g, unknown or other
  modified_base (326)..(326): a, c, t, g, unknown or other
  modified_base (424)..(424): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagagccggcaggccctgtgtggngatgtataaagacactgagaggcctgagggatcccgtagagcgtattcncgtggctcgaggtcagggacacggtcacgtagttcgccaatcgagtggacgtccgaggcagaggacgaggctagacttattattagtacaaatcaaanagaacaccagttcggtaacttatcgttactacgaacttgacgacgaaggtccaaccggtcgtacgggacacgacccgaaggcccaaaccctcgtcgtaccacttcgttaccc

SEQ ID NO: 434835 - DNA, 699 bp, Homo sapiens
  misc_feature: GZ8MTXP02H8341.51.81.H04.1.454.CMB.2.raw
tcagcgatcgtatacacgaccggtgctcgatttagtagtgtagattcgcgggggctgtgtgtccaggaggcagaactctgggtgtctcaccatggcctggatccctctacttcctccccctcctcactctctgcacaggctctgaggcctcctatgagctgacacagccaccctcggtgtctgtgtcctcaggacagacggccaggatcacctgctcgtggagatgctagttcgaccaaagcaatatgtacttactcggtaaccagacaagaacgccgaggccacggtcccctgttccgtttaggtttaattttaagtaaaagtacgttttaggaaggtacgggtccccttacgaacggggacccccttggacgtcgtaacgtttcctcgtcggcttccacgtcctcaacggtacgaaccaaacgtagttaccgacgtttcgaaccctatacgagggttcggaacgtcccgaagggcaaagggacggaccgaggcctaggaccttatttaacgtgtacgtacgtacagtaccgaagaacgagtacgtaggtacggaacttacgttaacgttcggttacgtttacgggttaccggaaccgggggtaaaccggtaaaccctaaaacggtcccggtaaccccggttaaccggtttaaaccgggggtccaaaccccggaccccggttaaaacggtccccccgg

SEQ ID NO: 434836 - DNA, 602 bp, Homo sapiens
  misc_feature: GZ8MTXP02GENZF.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagacggccctagagggactcccgtgagcgtacttctcgtggctccgaggtcaggggacaaacgggtcacgtattcggaccatcgagtggagtccgaggcgaggaggacgaggctagactatttagttgtactaaatacaaacagtaaccaacctagttacggttaactttagtacggtttctacgggtaaacttcggaccgtaaaccgtaacggtcctacccggttccgtcgggggttaccaacggtacccccgaaaacggacccccaaaccccctaacgttccggtaccttaaccccg

SEQ ID NO: 434837 - DNA, 683 bp, Homo sapiens
  misc_feature: GZ8MTXP02I7G85.51.81.H04.1.454.CMB.2.raw
  modified_base (482)..(482): a, c, t, g, unknown or other
tcagcgatcgtatacacgaccggtgctcgatttagtagtgtagattcgcggggctggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttattggtaccagcagaagccgggccaggcccctgtgttggtagtgtagtaaagaacactagtagacggccctcccgtaggacgtccctcgagcgtacttccttccgtcggtcgtcctacggtacgacgggacggaaccgtacgacagttcggtcgactacgacgtggtacgtaccgacggaccgaggaaggacggacgggacgtagggtactatttaagttacgttactaacttanaaaccgaaggtaaaccaacccgtaaccgttaggttaacgtttaacttacgtttacgtttaaccgggttaacgttacggaaccggtaacccgtaaaccgggtaaaccgttacccggttccgttacgggttccgaccggtaaccccggaaaccgaaccccggaaaccccctaaccgtacccgttaccgtaccgtttaaccccg

SEQ ID NO: 434838 - DNA, 541 bp, Homo sapiens
  misc_feature: GZ8MTXP02G3RNQ.51.81.H04.1.454.CMB.2.raw
  modified_base (423)..(423): a, c, t, g, unknown or other
  modified_base (432)..(432): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaaagacactgaagaggccctgaggggatccccgtgagcgaatttctctggctccgaggtcagggggaacaaaggtcacattggccatcagtggagtccgaggcagaggacgaggctgactattattgtanaatacaaanagacacctaagttgtaactttatgtacttacggaaacctgacgaccaaaggcctaacccggtctggggtaccaaggccccaaacggcccaaaaccccactcgactaacc

SEQ ID NO: 434839 - DNA, 575 bp, Homo sapiens
  misc_feature: GZ8MTXP02FP535.51.81.H04.1.454.CMB.2.raw
  modified_base (307)..(307): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtacagcagaagccggccaggcccctgtgttggtgatgtaataaagacactgagaggccctnagggactcccgtgagcgattctccgtggctcgaggtcagggacacggtcacagttcgccatcgagtggagtccgaggcagagacgaggctagactattagttgtacaaatcaaacagaacaacctagttaggtaccttagttcgtcgtttacggaactcggtaccgaaccctaagggtaccctaacccggttccgtacgggtaccaacggacccccgaaacgggacccccaaaaccccctcgtacgtccaaccgttccgtttccccgg

SEQ ID NO: 434840 - DNA, 647 bp, Homo sapiens
  misc_feature: GZ8MTXP02ILKMK.51.81.H04.1.454.CMB.2.raw
  modified_base (237)..(237): a, c, t, g, unknown or other
  modified_base (289)..(289): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatcacctgctctggagatgctattcgaccaaacgntatgacttattggtaccagcaagaacggccggccacggcccctgtggttggngaatgtaataaagacactaggaagacggcccctagaggggactcccgtagacgcgtaattctacgtcggcctccgaggtacgacgggaacacggtacactagttcgacctagcaggtgacgtccaggcgaaggacggacgaggtactagaacttagttattacgacaaactacaaacgaagtaaccaacctaaagtttcggttaaactttgtttacgttaccgttaacggtaaacgtcggtaaaccgaaaccgttaacggtacccgtaacccgttacggttacgggtaccaaaccggacccgaaaaccgaccccgaaaacccctcgttaaccgtaccctaaccttccgtttacccccg

SEQ ID NO: 434841 - DNA, 660 bp, Homo sapiens
  misc_feature: GZ8MTXP02G79S1.51.81.H04.1.454.CMB.2.raw
  modified_base (222)..(222): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggganatgcattcgacccaaaaccgattatgtacttagttcggtaaccagcgagaacggcccggccacggcccctgtgttggtgatgtaataaagacatagagacggcctgaacgggctcccgtgacgcgtattcgtccgtgcctacgaggtacgaacgggaaccgacggtccacgtagttcggacctagtcgagggtacgacgtccgacgggacgaagggaagggacggaggacgttacggtaactttaacgttagtttacggtaacttaaacttaccgaaaacgaaaccggtaactaaacccgttagtttacggtttaaccgtttagttcgtttacgttacgtaacgttacgacgaaccgtaacggtccgtaccgtcggtacggtaccaaccgacccaacggacccaacccgtactaccgtacctaccgttacttcccccg

SEQ ID NO: 434842 - DNA, 680 bp, Homo sapiens
  misc_feature: GZ8MTXP02FN7MB.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccacccgtggtgtcagtcgtcccgaggacagacgccaggatcacctgctcgtggagatgctattcgacccaaaccgatatgtacttagttcggtaccagcagaacggcccgggccacggcccctggtgttggtgatgtaataaacgcacgtgagacggccctagagggtactcccgtgaggcgtacttcctcgtggccttcgaggtcgacggaccaacggtcacgtattcggcctatcaggtggacgtaccgaggccgaaggacgggaacggacggtcgtacgtaacttacgtttaagtttacgtactaaactccgaaaaccgtacggaaccctaacccgttaagtttacgggtttaacctttaaagttcggtttaccgttaaccgggtaaaccgttacggacccggtaaacccgtaaacgggttcccgtaacccggttcccggtacggggttaccgaaccggacccccgaaacggacccccaaacccccgtaacgttccgtacccttacccg

SEQ ID NO: 434843 - DNA, 558 bp, Homo sapiens
  misc_feature: GZ8MTXP02FXLJO.51.81.H04.1.454.CMB.2.raw
tcagcgatcgtatacacgaccggtgctcgatttagtagtgtagattcgcgggggtgggtccaggagtcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggccaggcccctgtgttggtgatgtaataaagacactgagacggccctcgagggactcccgtgacgcgattctcgtggcctccgaggtcgaaggggacacgggtcactagttcgaccagtcagtggagtcccgaggcgaggaggacgaggctagacttattattagtacaaatacaacgagacaccgtattaggttacttagtgtcttacggaactgaccgacgtaaggtccaccgttaccgtcgggtaccacgaccccgaacggcccaaacccctcgtcgtaccacgttctccccg

SEQ ID NO: 434844 - DNA, 632 bp, Homo sapiens
  misc_feature: GZ8MTXP02J04TT.51.81.H04.1.454.CMB.2.raw
  modified_base (235)..(235): a, c, t, g, unknown or other
  modified_base (407)..(407): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgcccaaacgntatgcttattggtaccagcagaacgccggccacggcccctgtgttggtgatgtataaagacactgagacggccctgagggatcccgtgacgcgattctccgtggctccgaggtcgaagggacacgggtcacgtagttggcccatcgagtggacgtcgaggacaggaggacgnggtctgacttattacgttgtacaaatacaaacgacgaacctacctagtttacggttaacctttaagttcgttacgttaccgggtaaacgtcggtacccgaaaccgtaaacgggtcccgttaaccccggtccggtttacggggtaccaacccggtacccccaaaccgggtaccccccaaacccccgtaccgtttccggacccttaaccttacccggtttacccccg

SEQ ID NO: 434845 - DNA, 487 bp, Homo sapiens
  misc_feature: GZ8MTXP02IJADK.51.81.H04.1.454.CMB.2.raw
  modified_base (221)..(221): a, c, t, g, unknown or other
  modified_base (275)..(275): a, c, t, g, unknown or other
  modified_base (289)..(289): a, c, t, g, unknown or other
  modified_base (292)..(293): a, c, t, g, unknown or other
  modified_base (295)..(295): a, c, t, g, unknown or other
  modified_base (312)..(312): a, c, t, g, unknown or other
  modified_base (385)..(385): a, c, t, g, unknown or other
  modified_base (388)..(388): a, c, t, g, unknown or other
  modified_base (398)..(398): a, c, t, g, unknown or other
  modified_base (400)..(400): a, c, t, g, unknown or other
  modified_base (406)..(406): a, c, t, g, unknown or other
tcagcgatcgtatacacgaccggtgctcgatttagtagtgtagattcgcgggggctgtgggtccaggaggcagaactctgggtgtctcaccatggcctggatccctctacttcctccccctcctcactctctgcacaggctctgaggactcctatgagctgacacagccaccctcggtgtcagtcgtcccaggacagacggcaggatcacctgctctgganatgcattgaccaaacgatatgacttatggtaccagcagaagccggcagccctgngtggtgatgtaaanaannangagacgcctagagctcngagctctctcgtgtctcgagacgagaacgaacgacactatacgacatacgagagacgacgagagagagagagnganatatatatananacacanacacatatatatgtcgtacgtacagacaacgacgacgtaccgtcgtcgacgaacgaccaaccgaccaaccacctactacac

SEQ ID NO: 434846 - DNA, 590 bp, Homo sapiens
  misc_feature: GZ8MTXP02HN4SJ.51.81.H04.1.454.CMB.2.raw
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggcacggcccctgtgttggtgatgtataaagacactgagacggccctgagggactcccgtgacgcgtattctccgtaggctcccgaggtcgaggggactacgggtcactagttggaccatcaggtgggacgtcccgagggacaaggaggaccgagggactgaacttatttagtgttacaaattcaaacgagacctaacctagtttacggtactttagtgttacctttacgggaaacttcggaccgtaacgtaagggtccctaaccggtccgtcggtaccgacgacccgaacggacccaaacccccgacgtacgtaccacgtttctccg

SEQ ID NO: 434847 - DNA, 651 bp, Homo sapiens
  misc_feature: GZ8MTXP02GPE8A.51.81.H04.1.454.CMB.2.raw
  modified_base (221)..(221): a, c, t, g, unknown or other
  modified_base (238)..(238): a, c, t, g, unknown or other
  modified_base (281)..(281): a, c, t, g, unknown or other
  modified_base (334)..(334): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgntatgcttatggtaccagcagagccggcaggcccctgtgttggnatgtataaagacactgagaggccctgagggactcccgtgacgcgattcctcgnggcctcgaggtcgaggggaccaacgggtcacgtattcggaccatcgaggtggaacgtccgaggcgagacgggacgaggacctagattagttaattgtactaaatcaaacgacgacctaaccgtagtttaggtaaacctttagttacggtttcgttaacccgggtaaacgttcggaccggtaaacccgtaaaacgggttccctaaccccggggttcccgttacgggggttaacccgaacccggtaaccccccggtaaaacccggggacccccctaaaaaccccccgtaacgtttacccggttcccgtttaaacccccg

SEQ ID NO: 434848 - DNA, 597 bp, Homo sapiens
  misc_feature: GZ8MTXP02GRMBQ.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccgggccaggcccctgtgttggtgatgtaataaagacactgagacggccctcgagggtactcccgtgacgcgacttctctggcctcgaggtcgaggggacaacggtcacgagttcggccatcgaggtggagtccgaggcaggaggacgaggctagacttattagttgtactaaatcaaacgtacgaaaccacctagtttacggttaactttagtacgtttaccgtttacggaaaacgtcggtaccgaaaccgtaaacgggtaccctacccggtaccgtcggggtaccaacggaccccgaaacggaccccaaacccccacgtccgtactacccg

SEQ ID NO: 434849 - DNA, 557 bp, Homo sapiens
  misc_feature: GZ8MTXP02HANVQ.51.81.H04.1.454.CMB.2.raw
  modified_base (277)..(277): a, c, t, g, unknown or other
  modified_base (283)..(283): a, c, t, g, unknown or other
  modified_base (314)..(314): a, c, t, g, unknown or other
  modified_base (320)..(320): a, c, t, g, unknown or other
  modified_base (395)..(395): a, c, t, g, unknown or other
  modified_base (408)..(408): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggcaggccctgtgtgngatganaaagcactgagagcctcagggctccctgagngattcncgtgctccgaggtcagggacacggtcacattgaccatcagtgagtccgaaggcaggagacgaggctagactattntagacaatcaaanagacaactagttacgttacttagtcgttacgttacgaactcgtaaccgaacgtaacggtccgtaccggttaccgtacgggtaccaaccgaccccgaaaccggtacccccaaaaccccgtacgttaccgtacctaccgttcccgttcccg

SEQ ID NO: 434850 - DNA, 539 bp, Homo sapiens
  misc_feature: GZ8MTXP02FR08O.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtaataaagacactgagaggccctgagggactccctgagcgtattctcctggctcgaggtcagggacacgggtcactagttggccatcgagtggagtcccaggcaggaggacgaggctagactattattgtacaatacaactagaccactattggtaacttatgtcttagaactcggtacgaccgaagtccaccgttccgtcggggtcacgacccgaacggccccaaaccctactcgtaccactccgttacccg

SEQ ID NO: 434851 - DNA, 524 bp, Homo sapiens
  misc_feature: GZ8MTXP02GKPPN.51.81.H04.1.454.CMB.2.raw
  modified_base (236)..(236): a, c, t, g, unknown or other
  modified_base (424)..(424): a, c, t, g, unknown or other
  modified_base (486)..(486): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggcaggcccctgtgttggtgatgtaataaagacactgagaggccctgagggactcccgtgagcgattctcctggctcgaggtcaggacacggtcaactattcggccatcgaagtggacgtccgaggcaggagacgagctagactattagtgtacaatcaaanagacacctagttgttacttatgtactacggaactgacgacgaagttcacccgtctcggtacncgacccaaggcccaacccactcgtacacctcttacccg

SEQ ID NO: 434852 - DNA, 669 bp, Homo sapiens
  misc_feature: GZ8MTXP02IPXE8.51.81.H04.1.454.CMB.2.raw
  modified_base (175)..(175): a, c, t, g, unknown or other
  modified_base (239)..(239): a, c, t, g, unknown or other
  modified_base (243)..(243): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggatcacctgctctggagatgctattcgaccaaaccgnttangtcttattggtaccagcagagccggccaggccctgtgtggtgatgtaataaagacacgtgagacggccctacgagggactccgtgacgcgtattctccgtgctaccgaggtcgaacgggacgacgggtcaactagttcgacctagtcgtaggtgggagtccgaggacgaggaacgggacgacggtacgtacggtaaacttaagtttagttacgtaaacctaaacgttaaccaaaacgaccggtaaacctaaacccgttaacgttttacgggttaaccttttagttacggtttaccgttaacggaacgttcggaaccggtaaccggtaaacggtcccgtaaccggtccgttacgggtacccgaccgaaccccgaaccggaaaccccctaaccccgtacgttcgtaccctaccgttcctttacccccg

SEQ ID NO: 434853 - DNA, 544 bp, Homo sapiens
  misc_feature: GZ8MTXP02FUGID.51.81.H04.1.454.CMB.2.raw
  modified_base (281)..(281): a, c, t, g, unknown or other
  modified_base (428)..(428): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgtggngatgtataaagacactgagacgccctacgagggactccctgagcgtattctctggcctcgaggtcacgggacacgggtcactattcggccaatcgagtggatccgagacaggaggacgaggactagactatattgtacaaatacaanagtacacctattggtacttagtcgtcgttacggaactcgacgactaaggtcctaaccggtctacggggacacgacccgaacggacccaaacccacgtcgtaccacctacttacccg

SEQ ID NO: 434854 - DNA, 733 bp, Homo sapiens
  misc_feature: GZ8MTXP02GZVMX.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctggaggcctcctatgagctgacacagccaccctcggtgtcagtcgtccccaggacagacggccaggatcacctgctcgtggagatgctattcgacccaaaaccgtatagtcgtcttagttacggtaccagcaagaacggccgggccacggccccgtggtcggttggtagagttgttaaataaacgactaactggaaggacggcccctacggaaggggtaccttcccgtaggacgtcgtacttcctcgtacggccttacgacggtcgacgggggacctaaacgggtccaacgtacgttcggacctagtaccgaggttacggacgtacccggagggaccgagggaacgggacggaggggtacctaggtaaacctttaatttacgttacgttaacgaaacgttaccaaaacgaacgtaaaccctaaccgttaagttttacgggttaaacttttacgttaacgttccgtttaaccggaaaacgttcggacccggtaaaaccgtaacggtaccgtaaccccggttccgtacggggtaccaaccggaaccccgaaacgggtacccccaaacccgacggttaccgtaccgttaaccccg

SEQ ID NO: 434855 - DNA, 624 bp, Homo sapiens
  misc_feature: GZ8MTXP02JU58Y.51.81.H04.1.454.CMB.2.raw
  modified_base (236)..(236): a, c, t, g, unknown or other
  modified_base (278)..(278): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccatgatcacctgctctggagatgcattgaccaaacgntatgcttatggtaccagcagagccggcaggccctgtgtggtnatgtataagcatgagacggccctgagggtactcccgtagagcgtattccctcgtggctccgaggtcgagggtaccaacgggtcacgtagttcggcctagtcgagtggacgtaccgagggcgagacgggaccggaggacgtaggacttagttagttcgtactaaactacaaacacgaacctaaccgtaagtttaggttaacctttagttcgttaccgttaacgaaacgttcggtaacccgaaccgtaaacgggtcccgtaaccggttccgtacggggtaccaaccggaacccccgaaacgggaccccccaaaccccgtaccgtacgtacccgtaaccgtttcccccg

SEQ ID NO: 434856 - DNA, 619 bp, Homo sapiens
  misc_feature: GZ8MTXP02F4UIG.51.81.H04.1.454.CMB.2.raw
  modified_base (317)..(317): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgcttattggtaccagcagaagccggcaggcccctgtgttggtgatgtataaagacactggagaggccctcgagggntcccgtgagcgattctctcggctcgaggtcagggacacgggtcactagttcggcctatccaggtggacgtcccgaagggccaagggacgggacgagggcgtaggacttattagtttagtacaaattcaaagtaacgaacctaaccctagttaggttacttaagttgttaccgttacgggtaaacgtcgtaccggaaaccgtaagggtacccgtaaccggttccggtcggggttaccaccggaaccccgaaacggacccccaaacccctacggtacctaccggtaaccttccgtttacccccg

SEQ ID NO: 434857 - DNA, 635 bp, Homo sapiens
  misc_feature: GZ8MTXP02H8VX1.51.81.H04.1.454.CMB.2.raw
  modified_base (440)..(440): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgattatgtacttagttcggaccagcagaacgcccggccacggcccctggtgttggtgtatgtaataaagacactgaagacgcccctgagggctcccgtagacgtcgtattctccgtcggtcctaccgagggtcaacggggaacctacgggtcaacgtagtttcggacctagtcgaagtcgggacgtccgagggcaaggagggacgngggctagaacttagttactggtacaaacgtacaaacgagaacctaaccgtgtttacggtactttaagtcggtttccttaacgggaacttggaccgaaacccgtaaagggttcccaccggttaccgtacggggtaccaccggaccccgtaaacgggcccccaaaacccgtctggtaacccacctttccgttccccg

SEQ ID NO: 434858 - DNA, 675 bp, Homo sapiens
  misc_feature: GZ8MTXP02ID2Q1.51.81.H04.1.454.CMB.2.raw
  modified_base (193)..(193): a, c, t, g, unknown or other
  modified_base (219)..(219): a, c, t, g, unknown or other
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagccaccctcggtgtcagtgtccccaggacngacggccaggatcacctgctctgganatgctattgaccaaaccgatatgtacttattggaccagcagaacggccggcacggccctgtgttggtgatagtaataaagacacgtagagacggccctagagggactccctggacgcgtattctcgtcgcctcgaggtcgaagggacacggtcactgttcggcaatcagtggacgccgaggcgaagggaggaacgaggggtactacggtaaatttagtttagttacggtaactaaacttaccgaaaacaaccggtaacctaaacccttagtttaaacgggttaactttaggttaccgttaccgttaacgggtaacttacggaaccggtaaaaccgtaagggttaccccgtaaacccgggttccggttacggggtacccaaccggaaacccccgtaaacggggaccccccaaaacccggtaactccggtaaaccctaccgtttcctttaccccccgg

SEQ ID NO: 434859 - DNA, 703 bp, Homo sapiens
  misc_feature: GZ8MTXP02GY65S.51.81.H04.1.454.CMB.2.raw
  modified_base (241)..(241): a, c, t, g, unknown or other
  modified_base (288)..(288): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgnttattggtaccagcagaagccggcacggcccctgtgtggtgatgtanaaagacactgagacgcctcgagggactcccgtgacgcgtacttctcccgtggcctccgagggtacgaaggggaaccacggggtcaactaacgtttcgaccgtaatccgaggttacgggaacgttacccggaacgggaccgaagggaaacggggaaccggaaggggtaccctagggaacctttaaagtttaacgtttacggtaccctaaaataccgaaaactaacgaaccacccgtaaatttacgggttaacctttattacggttaccttaacgggtaaaacttcggaccgtaaacccgtaaacgggttaccctaaacccggttccggttacgggggtacccacggaaccccgaaacggggaccccctaaaacccccggtacctacggtaccctaccgtttacccgtttacccccg

SEQ ID NO: 434860 - DNA, 693 bp, Homo sapiens
  misc_feature: GZ8MTXP02FJN0F.51.81.H04.1.454.CMB.2.raw
  modified_base (333)..(333): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgaccaaaccgatatgcttatgtaccagcagaagccggcacggcccctgtgtggtgatgtaataaagacactgagaggccctcgagggactcccgtagagcgtactttcnccgtggcctcgaggtcgacggggactaccgggtcacaagtttcggaccctagtacgaggttacggacgttcccgaagggaccgaagggaacgggaacgggacgggtaccgtaggtaaacctttaaagtttacgtttacggttaactaaaagttaccaaaaccgtaacggaaaccctaaaccgttaacgttttaaggggtttaaccttttaaagttcgttaccgttttaccgggaaaacgttcggaaccggtaaaccgtaaacgggttcctaacccggttccgtacggggttaccaaccggaaccccgaacggaaccccaaacccccgtacgtaccggttacccaccttaccgtttccccg

SEQ ID NO: 434861 - DNA, 572 bp, Homo sapiens
  misc_feature: GZ8MTXP02F1X4G.51.81.H04.1.454.CMB.2.raw
  modified_base (239)..(239): a, c, t, g, unknown or other
  modified_base (281)..(281): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgcttatggtaccagcagagccggcaggccctgtgttggngatgtaataaagacactgagaggccctgagggtactcccgtgacgcgactttctcgtgcctccgaggtcgaggggacaacggtcactagttcggaccatcgagtggacgtccgaggcaaggaggacgaggctagacttattatgtactaatacaaacagaaccacctatttacggtacttagtgtacttacggaacttcggacgaaccgtaaaggtcctaacccggttccgtacggggtacaaccgaccccgaaacggccccctaaacccccgacttccggtacctacccg

SEQ ID NO: 434862 - DNA, 612 bp, Homo sapiens
  misc_feature: GZ8MTXP02GOU0O.51.81.H04.1.454.CMB.2.raw
  modified_base (223)..(223): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgcattcgaccaaacgatatgtcttattggtaccagcaagaacggcccgggccacggcccctggtcgttggtgatgtaataaagacactgagacggccctgagggactccgtgacgcgtacttctcgtggctccgaggttcgaggggaaccaacggtcacgtagttcggacctagtcgagtggacgtcgaggcaggacggacgaggtctagtaacttattacgttagtacaaatacaaagacgaaccaccgtattacggtaacttagttcgttacttaacgggtaacttcggaccgtaaccgtaaacgggtacctaacccggttccgtacgggtaccaacggccccgaaaccggacccctaacccctaccgtacgtacccttaacccg

SEQ ID NO: 434863 - DNA, 666 bp, Homo sapiens
  misc_feature: GZ8MTXP02FU73P.51.81.H04.1.454.CMB.2.raw
  modified_base (237)..(237): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattgtacagcagaagccgggccaggcccctgtgttggtgatgtataaagacactgagacggcccgtcaggggactcccgtgagcgtacttctcgtggcctcgaggtcgaggggaccaacgggtcaaccgatttcggaccattcgaggttcggggacgtacccgagggccaagggacgggaaccggaaggggcctaggacctttaagttacgtttaggtacctaaaattacccaaaacgagaaaccctaacccgtaagtttacgggtttaaccttaattacggttaccgttttaccgggaaaacgtttcggaccggtaacccgtaaaacggggttcctaacccggttccgtcggggttacccaacggaacccccgaaaacggggacccccaaaccccctaacgttccggtacccttaaccccg

SEQ ID NO: 434864 - DNA, 629 bp, Homo sapiens
  misc_feature: GZ8MTXP02IR23L.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaaaccgtatatgcttagtggtaccagcagacgccggcacggccctgtgtggtgatagtaataaagacactgagacgccctcgagggtactcccgtagaacgcgtacttcgtccgtggcctccggaggtcgaacgggaacaccgggtcaactacgttcggaccagtcgaggtggacgtccgaggcgaaggaggacgaggtctaggtaacttattagttacgtaactaaacgtacaaacacgaacctaaccgtagtttacggttaactttaagtcggttacgttaacggaactacggtaaccgtaaccggtaaacggtccgtaacccggttcgtacggtaccgaaccgaacccgaacggaccccaaaccctacgtcgtaccctacttccgttaccccg

SEQ ID NO: 434865 - DNA, 547 bp, Homo sapiens
  misc_feature: GZ8MTXP02G4WFJ.51.81.H04.1.454.CMB.2.raw
  modified_base (235)..(235): a, c, t, g, unknown or other
  modified_base (409)..(409): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtacagcagagccggcagccctgtgtggtgatgtataaagcactgagagcctgagggactccctgagcgattctctgctcgagtcgaggacacggtcacagttgccatcagtagacgtccgagcgaggaggacgaggctgaactagttattagtcaaatcaanagacactagttacggtacttatgttacgttacggaaacttcggaaccgaccgtaaaggtacccacccggttccgttcgggtaccacgaccccgaaggaccccaaaccccgactaccgtaccaaccttcgtttaccccg

SEQ ID NO: 434866 - DNA, 560 bp, Homo sapiens
  misc_feature: GZ8MTXP02JG8FR.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctgctcactctctgcacaggctctgaggcctcctatgagctgacacagccaccctcggtgtcagtgtccccaggacagacggccaggatcacctgctctggagatgcattgccaaacgatatgcttattggtaccagcagaagccggcaggcccctgtgtgtgatgtataaagacactgagacggccctgagggactcccgtgagcgtattccgtctcggctccgaggtacgaacgggtacaacggtacactagttcggactatcgagtggacgtccgaggcgagaggacgaggctgactattagtgtacaatcaacagtaccacgtagttggttacttatgttacgttacgaacgtcgacgtaacgtacggtacctaccggtccgtcgggtccaacgaaccccgaacggaccccaaaccccgtacgtactaccctacgttcccg

SEQ ID NO: 434867 - DNA, 695 bp, Homo sapiens
  misc_feature: GZ8MTXP02GVBGE.51.81.H04.1.454.CMB.2.raw
  modified_base (236)..(236): a, c, t, g, unknown or other
  modified_base (280)..(280): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaacgntatgcttatggtaccagcagaagccggcaggcccctgtgtggtnatgtaataaagacactgagacggccctgagggactccctgagcgtattctcgtgctccagggtcaggggacacggtcactaagttcggccagtcgagtacggacgtcccgaggccgaaggagggaaccggagggtccgtaggtaaccttaaagtttacgttacggtaacaaagtacaaaaccgtaagaaccctaaccgtaagtttacgggtaacctttaaggtcgttaccgtttaacggggaaaaccgttcgggaacccgtaaacccggtaaaacgggttacccccgtaaaaccccgggttcccggttacgggggttacccgtaaacccggacccccggtaaaacccggggtaacccccaaaaccccccggtactttacccggtacctaaccccggtttcccttttaacccccgg

SEQ ID NO: 434868 - DNA, 639 bp, Homo sapiens
  misc_feature: GZ8MTXP02HHYMW.51.81.H04.1.454.CMB.2.raw
  modified_base (237)..(237): a, c, t, g, unknown or other
  modified_base (280)..(280): a, c, t, g, unknown or other
  modified_base (341)..(341): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgntatgcttattggtaccagcagagccggcaggcccctgtgtggngatgtaataaagacacgtggagacggtcccctagacgggactcccgtaggacgcgtattcnccgtcggctccgaggtcgacgggacacgggtcaacgtagttcgggacccagtcgaggtacggacgtcccgaagggcgaagggacgggacgagggcgtaggtaactttagttagtttaggacctaaataccgaaacacggtaacctacctaagtttggttaacttagttcggttacgtttaccgggaaactcgtaaccggaaccgtaacggggttcctaacccgggttcgtacgggggtaccaaccggaccccgaacggacccccaaacccgtctacgtacctaaccgttccttccccg

SEQ ID NO: 434869 - DNA, 578 bp, Homo sapiens
  misc_feature: GZ8MTXP02I52QC.51.81.H04.1.454.CMB.2.raw
  modified_base (220)..(220): a, c, t, g, unknown or other
  modified_base (239)..(239): a, c, t, g, unknown or other
  modified_base (293)..(293): a, c, t, g, unknown or other
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgagcctcctatgagctgacacagcccaccctcggtgtcagtcgtccccaggacagacggccaggatcacctgctctgganatgcattcgaccaaaccgntatgtacttattggtaccagcagacgccggcacggccctgtgtggtgatgtaanaaagacactgagacggccctgagggtactcccgtgacgtcgatttcctccgtcggcctccgaggtcgacgggaccacggtcacgtagttcgacctagtcgaggtgacgtccgagacgagaggacgaggtctcggaacttattagttacgactaaacgtcaaaacgacgtaccaaccgttattacggttactttagtacgttcgttacgagtcgtacgacgtaacggtcaccgtcgtggtaccacgacccaacgtccccaaacctctactccactccgtttacccg

SEQ ID NO: 434870 - DNA, 663 bp, Homo sapiens
  misc_feature: GZ8MTXP02JYE3R.51.81.H04.1.454.CMB.2.raw
  modified_base (241)..(241): a, c, t, g, unknown or other
  modified_base (467)..(467): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgggagatgcattcgacccaaaccgntatgtacttattcggtaccagcagaagccggccaggcccctgtgttggtgatgtaataaagacacgtgagacggccctcgaggggactcccgtagagcgtattctccgtggcctcaggtcgacgggacacggtcactacgttcggccagtaccgagggttgacgtaccgagggacaggaggacggaaggcgtagtacgttattacgttaggtacaaagtaccaaanacggaacctaacctaagtttacgggttaacttaagttcgttaaccgttaccggtaaacgttacggacggtaaacccgtaacgggtacccgtaccccggttaccggtacggggttacccgaaccggacccccggtaaaacggaccccctaaaacccccgtcgttacccgtacctaaccccgttcgtttaaccccccg

SEQ ID NO: 434871 - DNA, 584 bp, Homo sapiens
  misc_feature: GZ8MTXP02I833B.51.81.H04.1.454.CMB.2.raw
  modified_base (218)..(218): a, c, t, g, unknown or other
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttattggtaccagcaagacgccggccacggccctgtgtggtgatgtaataaagacacgtagacgacggcccctagagggtactcccgtaggacgtcgtatttccgtccgtcggtcctacccgagggttccgaacggggacctaccggggtcaaacgtagttcgggacctagtccgaggtcggacgtccgaggacagggaaggacgacgggctaggtaactagttatgtacaaatacaacagaccactagttggttaacttgtacgttcttacgactgacgacgagtccacgtcgtcggacaccgccgaacgtccccaaccgtactcgacctacgtccttacccg

SEQ ID NO: 434872 - DNA, 775 bp, Homo sapiens
  misc_feature: GZ8MTXP02GIW7R.51.81.H04.1.454.CMB.2.raw
  modified_base (237)..(237): a, c, t, g, unknown or other
  modified_base (291)..(291): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgntatgcttatggtaccagcagaagccggccacggcccctgtgttggtgatgtaanaaagacactgagacggcccctgagggactcccgtagacgcgtattctccgtggcctaccgagggtcgaacggggaactaccgggtccaacgtacgttcgggacctaagtcgaagttggggacgttcccgaaggggccaaaggggaacggggaacgtacggggtaccttagggtaaacctttagtttaacgttaggttaacctaaaacggtttccaaaacgtaacggaaaccctaaacccgtaagttttaacgggttaaccttttaaagttcgggttacccttttaaacgggggaaacctttacggggacccggtaaaaccccggttaaacggggtttacccgtaaaccccggggtttcccggttacgggggttaaccccgaacccgggtaaccccccggtaaaaaccgggtaccccccggaaaaaccccccttaccggttacccggtttacccctaaacccggtttcccggttttaacccccgg

SEQ ID NO: 434873 - DNA, 538 bp, Homo sapiens
  misc_feature: GZ8MTXP02JPBBV.51.81.H04.1.454.CMB.2.raw
  modified_base (484)..(484): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagcggccaggcccctgtgttggtgatgtataaagacacgtgagaggccctgagggatccctgagcgattcgaccgtggctccgagtcgaggacacggtcacattcggaccatcaggtcggagtcccgaaggccgaaggacgggacgaggctcgatattaattgtacaaactcaaacagaccaacgtattggtacttagtgtcgttggaactgacgacctaggtacccncggtcgtcggacaccgaccgaaccgacccaacccactacgtactacctcgtccg

SEQ ID NO: 434874 - DNA, 554 bp, Homo sapiens
  misc_feature: GZ8MTXP02JB0TL.51.81.H04.1.454.CMB.2.raw
  modified_base (237)..(237): a, c, t, g, unknown or other
  modified_base (280)..(280): a, c, t, g, unknown or other
  modified_base (307)..(307): a, c, t, g, unknown or other
  modified_base (468)..(468): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccgntatgcttatggtaccagcagagccggcaggcccctgtgttggngatgtataaagacacgtgagagccctnagggactccctgagcgattcctcgtgctccgaggtcaggggacacgggtcacgattcggcctatcgaagtgacgtccaggacgagaggacgaggctgacgtattattagactaagtcaagacgacaccgtagttggttaacttagtgtccgttacggaacncggtaccgacgaaggttccaccgttccgtacggggtccacgaccccgaacggtccccaaaccccgctcgtccctactcgttacccg

SEQ ID NO: 434875 - DNA, 587 bp, Homo sapiens
  misc_feature: GZ8MTXP02FJPUP.51.81.H04.1.454.CMB.2.raw
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagattcattcgccaaaccgntatgcttattgtaccagcagaagccgggccaggcccctgtgttggtgatgtaataaagacactggagacggcccctcgagggactcccgtgagcgattccctctcggctccgaggtcgaaggggtaccaaacgggtcaacgtagttcgggccctaagtcgaaggttggacgtacccgagggcaaggaggacgaggcgtgaacttagttacttgtacaagtcaaacacgaacacctaagtttaggtactttagtgttctttagggaacttcggacgtaaccgaacggtcacccggtcgtcgggtaccacgaacccgaacggacccaaaccccgctacgtaccacttccg

SEQ ID NO: 434876 - DNA, 663 bp, Homo sapiens
  misc_feature: GZ8MTXP02I3OIW.51.81.H04.1.454.CMB.2.raw
  modified_base (179)..(179): a, c, t, g, unknown or other
  modified_base (293)..(293): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtntcagtcgtccccaggacagacggccaggactcacctgctcgtggagatgcattcgaccaaaccgatatgcttagttcggtaccagcagacggccggcacggcccctgtgttggnatgtataaagacactggaagcggtcccctagacgggtactcccgtggaagtccgtaactttccgtcgtcggtcctccgaaggttcacgggggacctaaacggtcaactgttcggacctatcgaggtacggacgtaccgaaggcgaaggacgggacgaggggtacacgtatttaagtttagttcgtaaactataccaaacgtaacgaaccaccgttagtttcggtaactttattacggttacgttacggaacttacgggaccgtaaaccgtaaagggttcccgtacccgttaccggtacgggttaacccgaaccgtaacccccgaacgggacccccctaaacccgtacgtttcggtaccctttaacccccg

SEQ ID NO: 434877 - DNA, 650 bp, Homo sapiens
  misc_feature: GZ8MTXP02GUBIU.51.81.H04.1.454.CMB.2.raw
  modified_base (221)..(221): a, c, t, g, unknown or other
  modified_base (240)..(240): a, c, t, g, unknown or other
  modified_base (289)..(289): a, c, t, g, unknown or other
  modified_base (624)..(624): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctgganatgctattcgaccaaacgntatgtcttattggaccagcagaacggccggcacggtccctgtgttggtnatagtaataagcacgtgagacggccctagagggtactccgtaggagtcgatttctcgtgcctaccgagggtcgaacgggacaacggggtcaacgtacgttcggacccagtccgaggtcggtacgacccggaagggaccgaagggaacgggaacggtagggccttaaggtaaactttagtttacgtttagtaacaaacgttacaaaacgacgtaaccaaccgtaagtttacggtactttaagttcgttaccgtttaacggacttacggaacctaaccgacggtcccgtaccggtcgtcggggtaccaccggaacccgaaccggtacccccaaaccncgttacgacttacctccgtttccccg

SEQ ID NO: 434878 - DNA, 563 bp, Homo sapiens
  misc_feature: GZ8MTXP02GHOGJ.51.81.H04.1.454.CMB.2.raw
  modified_base (221)..(221): a, c, t, g, unknown or other
  modified_base (238)..(238): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgntatgcttattggtacagcagaagccggccaggcccctgtgttggtgatgtataaagacactgagacggccctcgagggactcccgtgagcgtattctcgtggctccaggtcgacggggaacaacgggtcaacgagttcggcctatcgagtggacgtccaggcaggaggacgaggctgaactattaattgtacaagtcaaacagaccactattggtaacttagtcgttacgttcggaaacgttcgacgaccgtaacggtacctaccggtccgtacgggtaccaacggccccgtaaacggcccccaaaccctacgtcgtacctaccc

SEQ ID NO: 434879 - DNA, 527 bp, Homo sapiens
  misc_feature: GZ8MTXP02FHHR4.51.81.H04.1.454.CMB.2.raw
  modified_base (307)..(307): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtataaagacactgagaggccctnagggatcccctgacgcgtattctcccgtggcctcgaggtcgaggggactacgggtcaactagttggccagtcagtggagtccaggcagaggacgaggctgactagttatgtcaatcaaacagaacacctattggtactttatcgtcttacgaactgacgtaccaggtccacgttccgcgggtcacgacccaaggcccaaccccactcgtcacgtctaccc

SEQ ID NO: 434880 - DNA, 629 bp, Homo sapiens
  misc_feature: GZ8MTXP02G4IHE.51.81.H04.1.454.CMB.2.raw
  modified_base (225)..(225): a, c, t, g, unknown or other
  modified_base (243)..(243): a, c, t, g, unknown or other
  modified_base (287)..(287): a, c, t, g, unknown or other
  modified_base (298)..(298): a, c, t, g, unknown or other
  modified_base (326)..(326): a, c, t, g, unknown or other
  modified_base (611)..(611): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtgganatgcattcgaccaaacgnttatgtacttatggtaccagcagacgccggcacggcctgtgtgnatagtaataancagtgagacggccctagaggacctccgngacgtcgtacttcgtacgtcggccgtaccgaggtacggacggggaaccgtaacggtacctaacgtacgttcggaacctacgttaccgaggtacggaacgtaccggaggacgaaggacggacgaggtctagtacttaaagttacttataccaataccaaactaacgacctaactagtttacggttaactttaagtcgttactacgggtaaactcggaaccggtaaaccgtaacgtccgtacccgtcggttacggaccaaccggtaacccgaacgacccctaaaccncgttaccgtacttacccg

SEQ ID NO: 434881 - DNA, 598 bp, Homo sapiens
  misc_feature: GZ8MTXP02ICEE2.51.81.H04.1.454.CMB.2.raw
  modified_base (242)..(242): a, c, t, g, unknown or other
  modified_base (296)..(296): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccacctcggtgtcagtcgtccccaggacagacggccaggatcacctgctctggagatgactattcgaccaaaccgntaatgtcttattggtaccagacagaacggccgggccacggcccctggtgtggtnatgtaataaagacactgacgcggcctcgacggactccgtgacgtcgtacttccgtcgtggcctacgacggtacgacgggacgtaacggtacacgtagttcggactactacgaggtacggacgtccgaggcgaggaggaacgaggactagaacttagtttagtcgtaactaagtacaacgaacacaactagttacgtactttagtgttcgttacggaacttcggacgaaccgtacgtaccgtaccggtccgttaggaccaacggaccccgaacggaccccaaaccccgtactccgtactaccc

SEQ ID NO: 434882 - DNA, 644 bp, Homo sapiens
  misc_feature: GZ8MTXP02JY75P.51.81.H04.1.454.CMB.2.raw
  modified_base (218)..(218): a, c, t, g, unknown or other
  modified_base (277)..(277): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggtcaggatcacctgctctgganatgctattgaccaaacgatatgcttatggtaccagcagacgccggcacgccctgtgtgnatgtaataaagcactggacgacggccctagagggactcccgtgacgcgtattcgtccgtcggctccgaggtcgacggacaccggtcaactagttcgacctagtaccgaggtcggacgtacccggaggacgaagggacgggacggaagggccttaaggtaaccttaagtttacttaggtaaacctaaactaactaaaccgaaggtaacctaaccgttagtttaacgggtttaaacctttagtacggtttaccgttaccggggtaaacttacggaaccgtaaacccgtacgggttcctaacccggttccggtacggtaccaccgaaccgaaccggacccctaaaccgctcgtaccaccgtcttcccccg

SEQ ID NO: 434883 - DNA, 599 bp, Homo sapiens
  misc_feature: GZ8MTXP02FLU0C.51.81.H04.1.454.CMB.2.raw
  modified_base (216)..(216): a, c, t, g, unknown or other
  modified_base (221)..(221): a, c, t, g, unknown or other
  modified_base (238)..(238): a, c, t, g, unknown or other
  modified_base (278)..(278): a, c, t, g, unknown or other
  modified_base (287)..(287): a, c, t, g, unknown or other
  modified_base (318)..(318): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctntgganatgcattcaccaaacgntatgcttatggtacagcagagccggcacgccctgtgtggngtatgtaanaagacagtgagcggccctagagggactccgngacgtctacttctcgtgcctcgaggtacgaggggaacacggtacacgtagttcgaccatagacgtaggacgtcgaggacgaaggaccgggtagaacggctaagactttaaagttgttacgtacaaattaccgaaaacggactaaacctacttagtttaacggttaacttagttacgttacgtaacgtaaccgtcggtaaaccgaaccgtaacgggttacctccggtacgtcggaccgaaccgaaccccgaacgacccctaaccctacgtcctaccgtaccc

SEQ ID NO: 434884 - DNA, 618 bp, Homo sapiens
  misc_feature: GZ8MTXP02G3O6V.51.81.H04.1.454.CMB.2.raw
  modified_base (219)..(219): a, c, t, g, unknown or other
  modified_base (238)..(238): a, c, t, g, unknown or other
  modified_base (286)..(286): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgctattcgaccaaacgntagtgtcttagtcgtaccagcagacgccggacacggccctgtgtggtnatagtaataaagacactggagacggtcctaggagggactcccgtgacgtcgactttcgtccgtcgccgtccgtaggtacgaacggaacgtacggtcaactgttcgacctagtcgagggtcgagtaccgagacgaaggaggacggacggactagtaacttattagttactaactaaatacgaaacacgaactacctaagtttcggtaacttagtacgttccgttacggaacttcgaaccgtaaaccgtaggtaccctaccggtacggttacgaccgacgacccgaaccggaccccaacccgtactacgtaccctaaccgttcgtttacccccg

SEQ ID NO: 434885 - DNA, 691 bp, Homo sapiens
  misc_feature: GZ8MTXP02JXVI8.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtggagatgctattcgaccaaacgatatcgtcttagttcggtaccagcagacgccgggccacggcccctggtgttggagtatacgtaataaacgactacgtaggacggaccggcccgtagacgggtactcccgtaggacgtcgtaccttcgttcgcggtcctacgaggtacgacgggaccgtaacggtcacgtagttacggacctacgtcgtacggtaggtacgtacggaggacgaagggacgggacgaggtaccgtagttaaccgtttaagttacgtttagtaactaacgttaacaaacgtaacgaacccgtaacgtttaacggtttacggtttaaacgtttacgttaccggtttacgttaaccggtaaccgttacgaccggtaaaccgtaccgggtacctacccggtcgtacggtaccgaacccgtaccgaacccggtacccaaccccgtacgttaccgtaccttacccg

SEQ ID NO: 434886 - DNA, 684 bp, Homo sapiens
  misc_feature: GZ8MTXP02JPUPY.51.81.H04.1.454.CMB.2.raw
  modified_base (220)..(220): a, c, t, g, unknown or other
  modified_base (237)..(237): a, c, t, g, unknown or other
  modified_base (270)..(270): a, c, t, g, unknown or other
  modified_base (276)..(276): a, c, t, g, unknown or other
  modified_base (280)..(280): a, c, t, g, unknown or other
  modified_base (295)..(295): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccacctcggtgtcagtcgtccccaggacagacggccaggactcacctgctcgtgganatgcattgaccaaacgntatgcttatggtaccagcagagcggcacgcccngtgtgnagtntataagcacgtgagnggccctgacgggactcctggacgtacgtatttcgtccgtcggccttccgacggtacgaacggggacaccgggtcaaccgtattcgggactagtacgagggtacgacgtaccgagggacgagggaagaccgagggtctacggtaacttagtttattaggtacctaaagtaccctaaaagaacggtacctaaccgttaagtttacgggtttaaacctttagttccggttaccgtttacggaaaacgttcggtaaccggaaacccgtaaaacgggttcccgtaaaccggttacccggttcggggtaaccccgtaccggaacccccgaaaccgggacccccgtaaaaaccccctcggttacccgtaaccgtaccctttccggtttaccccccg

SEQ ID NO: 434887 - DNA, 578 bp, Homo sapiens
  misc_feature: GZ8MTXP02GW757.51.81.H04.1.454.CMB.2.raw
  modified_base (235)..(235): a, c, t, g, unknown or other
  modified_base (281)..(281): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggngatgtaataaagacactgagacggccctcgagggactcccgtgagcgattctccgtggctcgaggtcgagggacacggtcactagttgccatcgagtgacgtccgaggacgaggaggacgaggctagacttattattgactaaagtacaaacagaacctaaccagtttacggtaactttagtcgtctttacggaacttcgaccgaacctaaacggtccaacccggttcgtacgggtaccacggacccgaaacggacccccaaaacccgtcgttcgtacctaccgttccgtttccccg

SEQ ID NO: 434888 - DNA, 536 bp, Homo sapiens
  misc_feature: GZ8MTXP02GFRFX.51.81.H04.1.454.CMB.2.raw
  modified_base (283)..(283): a, c, t, g, unknown or other
  modified_base (338)..(338): a, c, t, g, unknown or other
  modified_base (517)..(517): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccacggcccctgtgttggngatgtaataaagacacgtgagaggccctcgagggactcccgtgagcgattctccnggcctcgaggtcgagggacacggtcactagtgccattcgagtgggacgtaccgaggacgaggaggacgaggctagactagttaatgtacaaatcaaacagactacattagtacttagtgtacttcgaactgacacgtagtccgaccgtcgtcggtacacgacccaagaccccaaacccnctcgtacaccgttctcccg

SEQ ID NO: 434889 - DNA, 580 bp, Homo sapiens
  misc_feature: GZ8MTXP02GNMB4.51.81.H04.1.454.CMB.2.raw
  modified_base (235)..(235): a, c, t, g, unknown or other
  modified_base (438)..(438): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggccacggcccctgtgtggtgatgtaataaagacactgagacggccctcgagggactccccgtagacgcgtattctccgtggcctaccgaggtcgaaggggactacgggtcacagttcggcctatcgaggtggagtccgaggcaggaggacgagctgactattatgtacaagtcaanacgacacctagttacggtacttagtcgttcgttacggaaactgaccgtaaccgaaggtccaaccggttccgtacggggtaccacgtaccccgaaacggaccccctaaaccctacgtacgtaccctaccttaccgttccccgg

SEQ ID NO: 434890 - DNA, 605 bp, Homo sapiens
  misc_feature: GZ8MTXP02HWFL5.51.81.H04.1.454.CMB.2.raw
  modified_base (234)..(234): a, c, t, g, unknown or other
  modified_base (434)..(434): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctggagatgcattgaccaaacgntatgcttattggtaccagcagaagccggaccaggcccctgtgttggtgatgtaataaagcactgagacggcccctgagggactcccgtgacgcgtattctccgtggcctcgagggtcagggacacggtcaacagttcggaccatcagtggatccgaggcaggaggacgaggtctaggaacttattagtgtacaatacaanagaaccaccgtaagttcggttaactttaagtcgttaccgttacgggtaaaaccttcgtaccgaaaccggtaaaccggtacctaacccggttaccgtcgggggtacccacggaccccgtaaacgggaccccctaaaccccgtacgtcgtaccctaccttaccgtttccccgg

SEQ ID NO: 434891 - DNA, 758 bp, Homo sapiens
  misc_feature: GZ8MTXP02H9FTQ.51.81.H04.1.454.CMB.2.raw
  modified_base (235)..(235): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggactgacggccaggatcacctgctctggagatgcattgccaaaccgntatgcttattggtaccagcagaacggccggccacggcccctggtcgtggtgatgtaataaaggacacgtgagacggccctacgagggactcccgtgaacgcgtattcgtccgtcggcctaccgaggtccgaggggaaccgaccggggttcaacgtaacgtttcggggacccaagttccgtaagggtacgggtacgtacccgaaggggaccgaaagggtaacggggtaacggacgggggtaccttagggtaaaccgtttatttaacgtttacggtaaaccgtaaacgttaacccgtaaaacccaagggtaaaccctaacccgtaaacgttttaggggttaaacccttttagttacggtttaccgttttaccggggaaaccgttacggtaccccgaaaccggttaaaacgggttcccgtaaacccgggttccgtttacgggggtaccctaacggacccccggaaaccgggtaacccccgaaaaccccctcgttaacggtcctaaacccgttaccgtttacccccg

SEQ ID NO: 434892 - DNA, 636 bp, Homo sapiens
  misc_feature: GZ8MTXP02GOU3A.51.81.H04.1.454.CMB.2.raw
  modified_base (237)..(237): a, c, t, g, unknown or other
  modified_base (282)..(282): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctggagatgctattgaccaaacgntatgtcttatggtaccagcagacgccggcacggccctgtgttggnatgtaataaagcacgtgagacgccctgagggtactccgtagacgtcgtacttcgtccgtggacctacgaggtcgaacgggaacgtacgggtcaacgtacgttcggaccctaagtccgtaaggtacgggactacccggaggacgagggacggacggagggtcctagtaacttagttagttagtaactaatacgaaacacgaacctaaccgtagtttacggtaactttacgtacgttaccgtttacggacgttacggaccgtaaaccgaacgggttccgaaacccggttccgtacggtaccacccggaccgaaccggtaccccaaccctacgtccgtacctaccgttccttacccg

SEQ ID NO: 434893 - DNA, 640 bp, Homo sapiens
  misc_feature: GZ8MTXP02JLVWU.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttatggtacagcagaagccggcaggccctgtgtggtgatgtaataaagacacgtgagacggcctcgagggtctccctggagcgacttctcgtcgctccgaggtcgaggggacacgggtcacgtagttcggacctatcgaaggtgggacgtcccgaggcgaaggaggacgagggctaggaacttattattagtacaaatacgaacagaccaacctagtttacggtaactttagtcgttaccgtttacggaaccgttcggaaccggtaaacccgtaacgggttacccgtaaacccgggttcccgttacgggggtacccaacccgggaacccccgaaacgggaaccccctaaaacccccgtacgttaccggttacccgtaacctttccgtttacccccggg

SEQ ID NO: 434894 - DNA, 772 bp, Homo sapiens
  misc_feature: GZ8MTXP02HRQCJ.51.81.H04.1.454.CMB.2.raw
  modified_base (219)..(219): a, c, t, g, unknown or other
  modified_base (290)..(290): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgattatgtacttattcggtaccagcagaacggccggccacggcccctgtgttggngtatgtaataaagacactagagacgccctgagggctcccgtgaacgtcgacttcgtccgtcggtcctaccgaggtacgaacggggaaccacgggttcaactagttaccggactacgtactaacgggtgtacgacccgaggccgaagggaacggtacggacggtaccgttacggaaactttagtttaagtttacggtaacctaaaacgttaacgtaaaaacgtaacgaaaccctaaacccgttacggtttaaggtttaaaccctttaaggtttccgtttaccggtttaaccgggaaaaccgtttacggaacccggtaaaacccggtttaaacgggtacccccgttaaacccggggttcccggtttaaccgggggtaccgtaaaccccgggaacccccggtaaaaccggggtaccccccaaaaacccccgttcgggttacccgttaacccgttaaacccgttttaccccgttttaccccccccg

SEQ ID NO: 434895 - DNA, 645 bp, Homo sapiens
  misc_feature: GZ8MTXP02JSH7R.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgctattcgaccaaacgatatgtcttagttggtaccagcaagaacgccggccacggcccctggtgttggtgatgtaataaagacacgtgagacggccctagagggactcccgtgacgcgtacgttctcgtcgcctcgaggtcgacggggaactaacggtccacgtagttcggacctatcgaggtacggtacgtccgaggacgaaggacgggaacggtacggcgtacgtaacttaagtttattacgtactaaataccaaacgaacgaacctaaccgttaagtttacggttactttagttacgttacgttacggtaacgttacggaaccgaaccgttaaacggtcccgtacccggttaccgtacgggttaccaaccggacccgaaccggacccctaacccctaccgtccgtacccttacccg

SEQ ID NO: 434896 - DNA, 612 bp, Homo sapiens
  misc_feature: GZ8MTXP02HA742.51.81.H04.1.454.CMB.2.raw
  modified_base (233)..(233): a, c, t, g, unknown or other
  modified_base (279)..(279): a, c, t, g, unknown or other
  modified_base (307)..(307): a, c, t, g, unknown or other
  modified_base (409)..(409): a, c, t, g, unknown or other
tcagcgatcgtatacacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggngatgtataaagacactagagaggccctnagggactccctgagcgattctcctggctacacggtcgaggacacggtcaacgtagttcggccaagtccaagtggacgtcccgaggacgagaagggtaacggnggcgtagtacttattacttagtactaaatacaaacacgtaacctaacgtagtttacggtaactttagttcgttacgttacggtaaacgtcgtaccggtaaacgtaacggtaccgtaaccggttaccggtacgggtaccgaaccgaacccgtaaaccggaccccgaaaacccgtaccgtaccggtacctaccgttaccgtcccg

SEQ ID NO: 434897 - DNA, 606 bp, Homo sapiens
  misc_feature: GZ8MTXP02JDAUM.51.81.H04.1.454.CMB.2.raw
tcagcgatcgtatacacgaccggtgctcgatttagtagtgtagattcgcgggggcgtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccgggccacggcccctgtgttggagatagtaataaagacacgtgagacggccctcgagggactcccgtgagcgacttctcgtggcctcgaggtcgacggggactaacgggtcagtagttcggaccatcgaggtggacgtaccgaggacaggagacgaagggctaggaacttagttattaggtacaaatacaacgtaaacgacaacctagtttaggttaacttgttacgtcgttacgtaacgtcgtaccgtaacgtaacggttcccgaaccggttccgtaggggtaccaacggacccccgaaacgggaccccctaaacccggtaccttccggttaacctaccccg

SEQ ID NO: 434898 - DNA, 835 bp, Homo sapiens
  misc_feature: GZ8MTXP02GYI06.51.81.H04.1.454.CMB.2.raw
  modified_base (220)..(220): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgganatgctattcgaccaaaaccgtatatggtcttagttcggtaaccagcaaggaacggcccggccacgggtcccctaggttggttggtagagttaggtaaataaaacgaccgtacgtaggaacggaccggtaccccgttacggaacggggtaaccttccccggtaggaacgtccgtaacgttttccgtcccggttcggggtaccctaccggtaacggggttacccggaaacgggggtaaaccccgtaaccgggggtccctaaacggttacggtttaccgggaaccctaacgtttaccggaagggttacgggaccggttacccgaaggggacggaaacgggtaacggggaacggtacgggaccgttaggtaaacctttaaagtttacgttacggtaacctaaaacgttacctaaaacgacggtaaacctaacccgttaaggttttaacggtacctttaagtccggttacggttaaccggtaaactcgggtaaacccgtaaccgtaaacgggttccctacccggggtaccgtaccgggggtacccaaccggaaccccgtaaacccgggaccccctaaaccccgtcgttaccggtacccacctttcccgttaaccccccgg

SEQ ID NO: 434899 - DNA, 703 bp, Homo sapiens
  misc_feature: GZ8MTXP02IT8OC.51.81.H04.1.454.CMB.2.raw
  modified_base (220)..(220): a, c, t, g, unknown or other
  modified_base (240)..(240): a, c, t, g, unknown or other
  modified_base (291)..(291): a, c, t, g, unknown or other
  modified_base (299)..(299): a, c, t, g, unknown or other
  modified_base (307)..(307): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtccagtcgtccccaggacagacggccaggatcacctgctctgganatgctattcgaccaaaccgntatgtcttattcggtaccagacagaaggccggccacggcccctgtgttggngatgtaanaaagacangagcgcctacgagggactcctgagcgtattctcgtcgctcgacggtcgacggacacggtcactagttcgccagtcggagtaggtcgacggaggacgacgggaaggacggacggtgttaggtaacttaagttattacgtaaactaaattaccaaacgacgtaaacctaacgtaacgttttacggttaactttacgtacggtttaccgttaacggggtaaactcggtaaccggtaacccgttaaaccgggtacccgttaaaccccgggttcccggttaccggggttaaacccgtaaccccggaacccccggtaaaacccgggtaaccccccctaaaaccccgttaccgtttaacccgggtaccttaaaccccggtttcccccggttttaaaccccccg

SEQ ID NO: 434900 - DNA, 728 bp, Homo sapiens
  misc_feature: GZ8MTXP02JU245.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattcgccaaaccgatatgcttattggtaccagcagaagccggcaggccctgtgtggtgatgtataaagcactgagagccctcgagggactccctgacgtcgattcgccgtgctcgacggtcgacgggacaccgggtacaactagttacgggaccagtaccgtaaggttacggggaacgttaccccgaaggggccgaaaaggggaacggggaacccgggttaaggggccccgttaacgggtaaacgtttaattttaagtttaacggttactaaaacgtttaccgaaaaccaaaggaaccctaaccctaagtttaacgggttaaccttttaagttcggtttaaccgttacgggtaaaaccgttcgggaaccgtaaaccccgggaaaggtttccccgaaacccggttacccgggtcggggttacccgaaacccggaccccgtaaaaccgggcccccccaaaaccccgtacggttacccggtaccgtaacccgtttaccttttccccccgg

SEQ ID NO: 434901 - DNA, 600 bp, Homo sapiens
  misc_feature: GZ8MTXP02FKWCJ.51.81.H04.1.454.CMB.2.raw
  modified_base (218)..(218): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaccgatatgactttattggtaccagacaggaacgccgggccacggccctgtgtggtgatgtaataaagacacgtgagacggccctcgaggggtactcccgtagacgcgtacttctccgtcggcctaccgaggtcgaacggggacaccgggtcaactagttcggacctatcgagtggatccgaggacaggaggacgagtctagacttagttattgtacaaatacaaagactacaacctagttaggtaactttagttcgttacttacgggactgaccgtaacgaacggttccaccggttcgtacgggtaccaacggaccccaaacggacccctaaaccccgtactaccgtacctacctaccgtttccccg

SEQ ID NO: 434902 - DNA, 669 bp, Homo sapiens
  misc_feature: GZ8MTXP02HFDBF.51.81.H04.1.454.CMB.2.raw
  modified_base (242)..(242): a, c, t, g, unknown or other
  modified_base (288)..(288): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaccgntatgcttatggtacagcagacgccggccacggcccctgtgttggtnatgtaataaagacactggaacgacggccctacgagggtactcccgtagacgtctacttcctcgtcggccttcgaggtcgacgggactaacggtcactagttacggacctagtacgtaggttacgggacgtccggaagggacgaacggggaacgggtacgggaacggtaccgttagtaacctttaaagtttacgtttaacggtaacgtaaacgtaacccaaaacgtaacgaaaccctaaccgttaaggtttaccggttaaactttacgttacggtttaccgttacggtaacgtcggtaccgtaaaccggtaacggtacccgtacccgtcggttcggaccaaccgacccgaacggtaccccaaccctacgtactacttacccg

SEQ ID NO: 434903 - DNA, 587 bp, Homo sapiens
  misc_feature: GZ8MTXP02ICIOT.51.81.H04.1.454.CMB.2.raw
  modified_base (220)..(220): a, c, t, g, unknown or other
  modified_base (238)..(238): a, c, t, g, unknown or other
  modified_base (327)..(327): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctgganatgcattgaccaaaccgntatgtcttagttggtaccagcagagccggccacggcccctgtggttggtgatgtaataaagacacgtgagcggccctgagggctcccgngagcgattctcgtggctccgaggtcgacggggactacgggtcacgtagttcggcctagtcgaggtgggacgtccgaggacgaggagggacgaggctagacttagttattgtacaaatcaacagacacctagtttacggtactttagtcgttcttacggaacgtcgtaccgtaccgtacggtccgtacccgtcgtcgggtaccaccggacccgaaacggcccccaaaacccgtcgtacgtacctaacctacccgtttcccg

SEQ ID NO: 434904 - DNA, 590 bp, Homo sapiens
  misc_feature: GZ8MTXP02FXRTY.51.81.H04.1.454.CMB.2.raw
  modified_base (238)..(238): a, c, t, g, unknown or other
  modified_base (277)..(277): a, c, t, g, unknown or other
  modified_base (289)..(289): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgaccaaacgtntatgcttatggtacagcagagccggcagccctgtgttgnatagtataaagnactggagacggccctgagggtactcccgtagagcgacttcgtcgtcggctccgaggtcgaggggaccaaacgggtcaacctagttcggaccctagtaccgaaggttcggaagtacccgaggacgaaggacgggacgtaagggcctaggacttagtttaatgtacaattccaaaagacaacacctaagtggttaacttagtcgtactttacgggaaccttgggaccaacgaaaggttccgaaccgtttcgacggggttaccaacgaccccgtaagaccccaacccacggtcgttactacccg

SEQ ID NO: 434905 - DNA, 576 bp, Homo sapiens
  misc_feature: GZ8MTXP02JLHOX.51.81.H04.1.454.CMB.2.raw
  modified_base (222)..(222): a, c, t, g, unknown or other
  modified_base (239)..(239): a, c, t, g, unknown or other
  modified_base (284)..(284): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttatggtaccagcagacgccggccacgcccctgtgttggngatgtaataagacactgagacgccctgaggactcccgtgacgtcgtacttcgtcgtcgcctcgaggtcgacgggactaaacggtcacgtagttcggacctagtcgtagtacggacgtaccgaggcgaaggagggacgaaggctagtacttagttattagtactaagtacaacacgactaacgtagttaggtacttagtacgttcgtacgtaacgtcgaccgaacgtaacgttcacccggttcgtggtaccaaccgacccgaacgaccccgaaaccctctccgtactaacccg

SEQ ID NO: 434906 - DNA, 643 bp, Homo sapiens
  misc_feature: GZ8MTXP02HCVAQ.51.81.H04.1.454.CMB.2.raw
  modified_base (242)..(242): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgctattcgaccaaaccgntatgtcttattggtaccagcaagaacgccggccacggcccctgtgtggtgatagtaataaggcagtgagacggccctgagggactccgtgacgcgtacttctcgtcggctcgaggtcgaggggacctaacggtcacgtagttcggacctagtcgaggtcggacgtccgaggcgaggacgggacggaggtctagtacttaagtttagttacgtactaaaacgttacgaaacgaacgaacctaacgttagtttacggtaactttacgtacggtttaccgttaaccgggtaaaacgtcggtaccggaaaccgttaaacgggtcccgtaaccggttacccggtggttaccgaacccggtacccgaaacccggtccccaaaacccctcgtacgtacccttaacccg

SEQ ID NO: 434907 - DNA, 641 bp, Homo sapiens
  misc_feature: GZ8MTXP02IK4CM.51.81.H04.1.454.CMB.2.raw
tcagcgatcgtatacacgaccggtgctcgatttagtagtgtagattcgcgggggctgtgggtccaggaggcagaactctgggtgtctcaccatggcctggatccctctacttcctccccctcctcactctctgcacaggctctgaggcctcctatgagctgacacacgcccacccgtcggtgtcagtcgtccccaggacagacggccaggactcacctgctcgtggagatgcattcgaccaaacgatatgtcttattcggtacagcaagaacgccgggccacggcccctgtgttggtgatgtaataagacactgagcgccctgaggactccgtgacgcgtacttctcgtcggcctccgaggcgacggggacaacggtcaacgtagttcgggactacgtacgtaggtacggacgtaccgacgggcgaagggacgggacggagggtctaggtaacttaagtttagttacgtactaaactacaaacgaacgaacctaccgtaagtttacggttaaactttagttacgttacgtttacggtaaacgttacggaaccgtaaccggtaaacggtccgtacccggttacgtcggttaccgaaccgacccgaaccggaccccaaacccgtacgttcgtaccttaacccg

SEQ ID NO: 434908 - DNA, 618 bp, Homo sapiens
  misc_feature: GZ8MTXP02JMPY2.51.81.H04.1.454.CMB.2.raw
  modified_base (236)..(236): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagaagccggccaggcccctgtgtggtgatgtaataaagacatgagaggccctcgagggactcccgtgacgcgattctctggctccgaggtcaggggacacggtcactagttcggaccagtcaggtcgacgtacccgaggaccgaggaagggacggacggacctaggtaacttagtttaacgttaggtacaaattacaaacaaggacctaacctaagtttacgggtaacctttaagttcggttacgtttaacgggaaacttcggaccgtaaccgtaaacgggtcccaaccggttcgtacggggtactaaccggaccccgaacggtaccccaaccccacgtaccgtacctaaccttccgtttcccg

SEQ ID NO: 434909 - DNA, 581 bp, Homo sapiens
  misc_feature: GZ8MTXP02HQFKZ.51.81.H04.1.454.CMB.2.raw
  modified_base (237)..(237): a, c, t, g, unknown or other
  modified_base (282)..(282): a, c, t, g, unknown or other
  modified_base (331)..(331): a, c, t, g, unknown or other
  modified_base (374)..(374): a, c, t, g, unknown or other
  modified_base (422)..(422): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaacgntatgcttattggtacagcagaagccggccacggccctgtgtggtnatgtaataaagacactgagacggccctgagggactccctgagcgattcncgtgctcaggtcaggacacggtcacagttcggaccatcgtagnggacgaccgaggcaggaggacgaggctagatattatgtacaatacaanagacaacctagttacggtacttagtgttacgttacgaaacgttcgaacgtaaccgaaacggtcctaaccggtccgttacggggtaccaacccggacccgaaaaccgggtacccccaaaaccccgtttacccgtaccgtaccctaccgtttcccgtcccg

SEQ ID NO: 434910 - DNA, 545 bp, Homo sapiens
  misc_feature: GZ8MTXP02IERXX.51.81.H04.1.454.CMB.2.raw
  modified_base (325)..(325): a, c, t, g, unknown or other
  modified_base (336)..(336): a, c, t, g, unknown or other
  modified_base (432)..(432): a, c, t, g, unknown or other
  modified_base (456)..(456): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgtcttattggtaccagcagaacggccggccaggcccctgtgttggtgatgtaataaagacactgagacggcccctgagggactcccngacgcgattcnctggcctcgaggtcagggacacgggtcacagttgacctatacagtcgggagtcccgaggcaggagacgaggctagactattatgtacaaatcaaanagacacctagttacgtactttagngttctacggaactgaccgaacaagtctacccgtcgttacgggacacgtcccaacggcccctaaacccgctgtacccacttcttaccccg

SEQ ID NO: 434911 - DNA, 567 bp, Homo sapiens
  misc_feature: GZ8MTXP02GBNQX.51.81.H04.1.454.CMB.2.raw
  modified_base (215)..(215): a, c, t, g, unknown or other
  modified_base (219)..(219): a, c, t, g, unknown or other
  modified_base (423)..(423): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcactgctcngganatgcattgaccaaacgatatgtcttatggtaccagcagacgccggccacggccctgtggtggtagtatagtaataaagactacgtagacgacggccctagacgggtactcccgtgagcgtattcctcgtggcctcgaggtcgaagggaacacgggtcactagttcgacctagtcgaagtggactccgaggacagaaggacgagntagacttatattagtacaaatacaaacgacaacactaagttcggttaacttatgttcgttagaactcgacgacgaagtcctaccgtcctagggaccacgacccgaaacggtccccaaaccccgtatcgtaactcttccgtcccg

SEQ ID NO: 434912 - DNA, 531 bp, Homo sapiens
  misc_feature: GZ8MTXP02H62G1.51.81.H04.1.454.CMB.2.raw
  modified_base (313)..(313): a, c, t, g, unknown or other
  modified_base (329)..(329): a, c, t, g, unknown or other
  modified_base (387)..(387): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggcccctgtgttggtgatgtataaagacactgagaggcctcgagggntcctgagcgattctcngtctcgaggtcagggacacggtcacagttcgcatcagtggagtccaggcaggagacgnggctgactattatgtacaatcaacagacacctagttagtacttagtgtacgttcgaacgtgtacgaaccgtaaaggtccaccggtccgtcggggtacacggacccgaaacggccccaaacccgactcgacctactaccttcccg

SEQ ID NO: 434913 - DNA, 657 bp, Homo sapiens
  misc_feature: GZ8MTXP02IWM4K.51.81.H04.1.454.CMB.2.raw
  modified_base (220)..(220): a, c, t, g, unknown or other
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctgganatgcattcgaccaaaccgatatgtcttagtcggtaccagcaagaacgccgggccacggcccctggtgttggtgatgtaataaagactactagaggacgccctagagggtactcccgtgacgctattctccgtggcctaccgaggtcgaaggggaacacgggtcaacgtagttcggacctagtacgtagtcggacgtccgaggacgaaggacgggaacgacggactacggtaacttagttaagttacgtactaaaactacgaaacaacgtaacctaaaccgtaagtttacgggttaactttagttacgttaccgttaaccgggaacttacggtaaccgaaaccgtaacgggtaccctacccggttacgtacggggtaccaaccggacccgaaaccggaccccaaaccccgtacgtcctaacctccgtacgtttccccg

SEQ ID NO: 434914 - DNA, 638 bp, Homo sapiens
  misc_feature: GZ8MTXP02JH18V.51.81.H04.1.454.CMB.2.raw
  modified_base (297)..(297): a, c, t, g, unknown or other
  modified_base (594)..(594): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctggagatgcattcgaccaaaccgatatgtcttagttggtacagcaagacgccggccacgcccgtgtggtggtgtatagtaanaaacgacatggagacgccgtacgaggctccgtgacgtctattctcgtcgtcctacgaggtcgaacgggacgtacggtccaacgtacgttacggacctagtaccgtagggtacggtacgacccggaggacggaagggacgggaaacgcggtacgtaacggtaactttagttaacgttagtaacgtaaactaaccgaaactaacggtaaccctaaccgttaagtttacggttaactttagtacgttccgttaacgtacgtacgtaccgaacgtaacggtccctaccggtcgtcgtaccncgaaccgaacgacccaacccgtctcgtacctacctcgttacccc

SEQ ID NO: 434915 - DNA, 621 bp, Homo sapiens
  misc_feature: GZ8MTXP02IH2GX.51.81.H04.1.454.CMB.2.raw
  modified_base (221)..(221): a, c, t, g, unknown or other
  modified_base (238)..(238): a, c, t, g, unknown or other
tcagcgatcgtatacacgaccggtgctcgatttagtagtgtagattcgcgggggctgtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcactgctctgganatgcattgacaaaccgntatgtcttatggtaccagcagaagccggccaggcccctgtgttggtgatgtaataaagcaatgagacggccctgaggatcccgtgacgtcgacttctcgtcggctcgaggttcgacggggaactaacggtcaacgtacgttcggacctatccgaggtaggtacgtccgaagggccagggaaacggggacgaacggggacttacggtaactttaagtttagttagtaactaaactacaaaacgaacactaaacctagtttaacggttactttaagtcgttacttaaccggaacgttcgaccggtaactaacgggtaccctaacccgtccgtcggttcaaccggtacccgaaacggcccccaaaacctcgtaaccgttctacccg

SEQ ID NO: 434916 - DNA, 605 bp, Homo sapiens
  misc_feature: GZ8MTXP02HE8VQ.51.81.H04.1.454.CMB.2.raw
  modified_base (219)..(219): a, c, t, g, unknown or other
  modified_base (283)..(283): a, c, t, g, unknown or other
  modified_base (327)..(327): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgatatgtcttatggtaccagcagaacggccggccacggccctgtgtggnatgataaagcatgagcgccctgagggactccctgagcgacttcncctggcctcgaggtcagggacacggtcaactagttcggcctagtcgagtaggctacgaggcgaaggacggacggtagccgttagaacttagttagttagtacctaaagttacaaacgaggtacctaaacccgtagtttaggttaccttaagttacgttaccgtttaacggaacttagacccggaaccgtaaagggttcccctaaccggttcccggtagggtcccaacgtaaccccgaacggtaccccaaccacgttacacctaccgtacgtttccccg

SEQ ID NO: 434917 - DNA, 586 bp, Homo sapiens
  misc_feature: GZ8MTXP02HRO7L.51.81.H04.1.454.CMB.2.raw
  modified_base (239)..(239): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgctattgaccaaacgntatgcttatggtaccagcagaagccggcaggcccctgtgttggtgatgtataaagacacgtgagacggccctagagggtactcccgtagagcgtacttctcgtggccttcgaggttcaggggaccaaacggtcaacgagttcggaccagtcgaagtggacgtccaggcgaggaggacgagggctaggacttattagttcgtacaaatcaaacagaccaacctagttacggtactttagtgttacgttacggtaacttcgacgtaaaccgaaggttaccaccgttccgtagggtaccaaccggaaccccgaacggacccccaaacccctacgttaccgtactaacccg

SEQ ID NO: 434918 - DNA, 504 bp, Homo sapiens
  misc_feature: GZ8MTXP02FEG87.51.81.H04.1.454.CMB.2.raw
  modified_base (218)..(218): a, c, t, g, unknown or other
  modified_base (331)..(331): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacgccaggatcacctgctctgganatgcattgccaaacgatatgcttattggtaccagcagaagccgggccagggccccctgtgttggtgatgtataaagacactgagaggcccctcagggatccctgagcgattcncctggcctcaggtcagggacacggcacattgcatcagtgagtccgaggcagaggacgagctagactattattgtcaaatcaacagacacattggtacttatgtcttcggaactgacgacaaggtcaccgtctggtcagcccaaggccctaaccccactcgtacactcttcccg

SEQ ID NO: 434919 - DNA, 595 bp, Homo sapiens
  misc_feature: GZ8MTXP02JY1C4.51.81.H04.1.454.CMB.2.raw
  modified_base (218)..(218): a, c, t, g, unknown or other
  modified_base (328)..(328): a, c, t, g, unknown or other
  modified_base (445)..(445): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgacccaaaccgattatgtctttattggtaccagcagagccggccaggcccctgtgttggtgatgtaataaagacactgagacggccctcgagggactcccgngacgcgattctccgtgctcgaggtcgagggacacgggtcactagttcgccatacgaggtgggacgtacccgaggcgaggacggacgaggctagacttattattagtacaagtacaanacgacacctagtttaggtacttagttcgtcgtttacgactacgaccgtaacgtaacggtccaaacccgggttcgtacgggtaccgaccggtaccccgaaaccggacccccaaaaccccgtacgtacgtccaaccgttccgtttacccccg

SEQ ID NO: 434920 - DNA, 543 bp, Homo sapiens
  misc_feature: GZ8MTXP02FZYPD.51.81.H04.1.454.CMB.2.raw
  modified_base (296)..(296): a, c, t, g, unknown or other
  modified_base (305)..(305): a, c, t, g, unknown or other
  modified_base (389)..(389): a, c, t, g, unknown or other
  modified_base (507)..(507): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcgacctgctcgtggagatgactattcgaccaaaccgtatatgtcttagttggtaaccagcaggaacgccggccacggcccctgtgttggtanatggtaaanaagacagtgagcgccagacggactcgtgacgtctctcgcgtcgcacgaggacgaggacgcgtacacgtagtcgctagtcgaggngacgacgaggacgaggacggacgaggtctagtacttattattacgacaacacaacacgactactagttacgttacttagtcgttactacgactacgtacgacggtacgtccgacgtcncggaccacgaccaacgacccactctcactctcgtcc

SEQ ID NO: 434921 - DNA, 652 bp, Homo sapiens
  misc_feature: GZ8MTXP02IN5YB.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgtctttattggtaccagcagagccggccagcccctgtgtgtgatagtataaagacatgagacgcctcgagggactccgtgacgcgtattctcgtggcctccgaggtcgaagggaccacggggtacacgtacgttcggacctagtacgaggtaggacgtacccggaggacgaagggaacgggaacggagggtacgttaggtaaaccttaagtttacgtttacggtaactaaaactaaccgaaacgtaacgaacctaaaccgttaagtttacggtttaacctttagttacgttaccgtttaacggaaactcggaccgtaaaccgtaacggtcctacccggtcgtcgggtaccacggtaccccgaaacgacccccaaaccctacgttaccgtacctaccgttccgtttaccccg

SEQ ID NO: 434922 - DNA, 602 bp, Homo sapiens
  misc_feature: GZ8MTXP02G8LEL.51.81.H04.1.454.CMB.2.raw
  modified_base (208)..(208): a, c, t, g, unknown or other
  modified_base (239)..(239): a, c, t, g, unknown or other
  modified_base (285)..(285): a, c, t, g, unknown or other
  modified_base (289)..(289): a, c, t, g, unknown or other
  modified_base (463)..(463): a, c, t, g, unknown or other
  modified_base (580)..(580): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagcccaccctcggtgtcagtcgtcccaggacagacgccagatcacctnctcgtggagactgctattcgaaccaaacgtntatgtctttattcgacagcagaacgccggccacggccctgtgtggnatanaataaagcacgtgagacgcctcgagggactcccgtagacgtcgtattcgtccgtacgccgttaccgagtacggacggaacgtacggtacacgtatccggacctaagcgtaggtagtacgaccgaggacgaggacgtacgacggtctagtactagttattacgactaagtacaanacgacgtaactagtttagaatttcgtagttacgttacgaactcggaaccgaccgtaacggtccctaaccggtctacgggtaccaccgaacccgtaaccgacccctaaccgtaccttntccctaacgtcccttaaccccg

SEQ ID NO: 434923 - DNA, 603 bp, Homo sapiens
  misc_feature: GZ8MTXP02J0I7I.51.81.H04.1.454.CMB.2.raw
  modified_base (219)..(219): a, c, t, g, unknown or other
  modified_base (287)..(287): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgactattcgaccaaacgatatgtcttatggtacagcagacgccggcacgccctgtgtgtgatgtanaagacagtagaggcgcctacgaggactccgtgacgtcgtacttcgtccgtcgtctcgacggtacggagggaaccacggtcaacgtagttcggacctagttacgagggtacggacgtaccgaggacgagggacggacgagggtactacgtattagttagttcgtaacaacgtacaaacgtacgaacctacgttaagttacgttaacttaagttcggttaccgttacggaaacgtcgaccgtaacgacggtaccctaccggtacgtcgggaccaccgtaaccgaaccggacccaccgtcgtacgcgtacctcctcccg

SEQ ID NO: 434924 - DNA, 621 bp, Homo sapiens
  misc_feature: GZ8MTXP02JS081.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgacccaaacgatatgtacttagttggtaccagcagaacgccggccacggcccctgtgttggtgatgtataaagacacgtgagacggccctcgaggggactcccgtggacgtcgtattcgtccgtcggtcctccgagggttcgaacggggactaccgggtcaacgtagttcggcctatacgaggtgacgtccgaggcaggaggacgaggctagacttattagttgtactaaagtacaaacgagaacacctagttacggttaaccttagtacgttccgtttacggaacgttcggaccgtaacgtaacggtaccgacccggttccggtcggtacccgacgacccgtaaacggacccccaaaccccgtacgtcgtacctaccgttacgtttccccgg

SEQ ID NO: 434925 - DNA, 553 bp, Homo sapiens
  misc_feature: GZ8MTXP02HTAD7.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcactgctctggagatgcattgaccaaaaccgatatgcttattggtaccagcagaagccgggccaggcccctgtgttggtgatgataaagacactgagaggccctacgagggatccctaggacgcgattctccgtggcctccgaggtacacggggacaacgggtcaacagttcgccagtcaggtggagtccgaaggcgaggaggacggaggactgactattatagtacaatcaaacagaacacctagttacggtactttatgttacttcggaaacttgaccgaacaaagggtcctaaccgtccgagggtcacgccccaaaggccccaaacccactcgtaccactcttcccg

SEQ ID NO: 434926 - DNA, 710 bp, Homo sapiens
  misc_feature: GZ8MTXP02G8KW3.51.81.H04.1.454.CMB.2.raw
  modified_base (221)..(221): a, c, t, g, unknown or other
  modified_base (241)..(241): a, c, t, g, unknown or other
  modified_base (306)..(306): a, c, t, g, unknown or other
tcagcgatcgtatacacgaccggtgctcgatttagtagtgtagattcgcggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctcgtgganatgctattcgaccaaaccgntatgtacttagttggtaccagcagaacggccgggccacggcccctgtgtggtgatgtaataaganactgagacgccctacgagggactccgtgacgcgtacttctcgtggctacgaggtcgagggacaaacggtcaacgagttacggacctaagtccgaaggttcgggaacgtcccgaaggccgaagggaacgggaaccggtaagggaccgtacggtaaacgtttaatttaacgttaggttaaaccttaaaacgtaaaccaaaacgtaacgtaaacctaaaccgtttaaggtttaacggtttaaacgtttacgttaccggtttaccgttaaccggtaaaccgttaccggaaaccgtaaacccggtaaaccgggtacccgttacccggttaccggttaccggtaacccgaacccgtaaccccgaaacccggaccccctaaaccccgtacgttaccgtacccgttaacccg

SEQ ID NO: 434927 - DNA, 516 bp, Homo sapiens
  misc_feature: GZ8MTXP02FGPD8.51.81.H04.1.454.CMB.2.raw
  modified_base (235)..(235): a, c, t, g, unknown or other
  modified_base (420)..(420): a, c, t, g, unknown or other
  modified_base (441)..(441): a, c, t, g, unknown or other
  modified_base (501)..(501): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccagggccccctgtgttggtgatgtaataaagacactgagaggccctcaggggatcccctgagcgagtttctcctggctccaggtcagggacacgggtcacattgcatcagtgagtcccagcagaggacgaggctagactattattgtacaatcaanagacacactggtacttatgtntcgactgacgacaaggtcaccgtccgtcggtacacgacccaacggcccaaaccccacgtntcacctctttacccg

SEQ ID NO: 434928 - DNA, 668 bp, Homo sapiens
  misc_feature: GZ8MTXP02ICFGM.51.81.H04.1.454.CMB.2.raw
  modified_base (180)..(180): a, c, t, g, unknown or other
  modified_base (226)..(226): a, c, t, g, unknown or other
tcagcgatcgtatacacgaccggtgctcgatttagtagtgtagattcgcgggggctgtgggtccaggaggcagaactctgggtgtctcaccatggcctggatccctctacttctcccccctcctcactctctgcacaggctctgaggcctcctatgagctgacacagcccaccctcggtntcagtcgtccccaggacaggacggccaggatcacctgctcgtgganatgctattcgaccaaaccgtatatgtcttatggtaccagcaagaacgcccggccgacggtcccctggtcgttggtagagtagtaaataaacgacaacgtggagacggtcccctgagggacctcccgtagacgtcgtacttcgtcgtcggcctcgaggtccgaggggaaccacggtacaccgtagttcggcctattccgaggtggacgtcccgaaggacgaggacgggacggagggtctaggtaactttagtttaacgttacggtactaaacttaccgaaacgaaccgaaccgtaacctaggtttacggttaactttagttacgttccgttaacggacttacgaccggtaacgtaaaccggtccctaacccggtccgttacggtaccgaaccgaacccccgtaaccggacccccaacccgtaccttacgtacccgttaacccg

SEQ ID NO: 434929 - DNA, 576 bp, Homo sapiens
  misc_feature: GZ8MTXP02HGAL8.51.81.H04.1.454.CMB.2.raw
  modified_base (477)..(477): a, c, t, g, unknown or other
  modified_base (565)..(565): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctggagatgctattcgaccaaaccgtatatgtactttagttcggtaccagcaagaacggcccgggccgacggccccgtgtgttggtagtatagtaataaagacagtgagacggccctgaggacctccgtagacgtctacgttctcgtacgggtctaccggaggtacgacggggaaccaacggtacacgtaagttcggacctagtcgagtcggacgtcgagacgaggaggacgaggctagacttattactatacatacanagacactagttcgtattattcgtacgtacgtaacgtgaccgtacgaacggtcaccggttcgcggtcaaccgtacgacgaccaaccccngtacactaccg

SEQ ID NO: 434930 - DNA, 630 bp, Homo sapiens
  misc_feature: GZ8MTXP02F5KYW.51.81.H04.1.454.CMB.2.raw
  modified_base (239)..(239): a, c, t, g, unknown or other
  modified_base (483)..(483): a, c, t, g, unknown or other
  modified_base (603)..(603): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctggggcctcctatgagctgacacagccaccctcggtgtcagtcgtccccaggacaggacggccaggatcacctgctctggagatgctattcgaccaaacgntatgcttatggacagcagacgccggcacggccctgtgtggtgtatagtaataaagacactagacggaccggcccttcgaaggtctacccgtggacgtcgtattcctcgtcggtcctaccggacgggtacgacgggtaaccgaacggtccgaactagttcggaccagttcgaagggttggaacgtccgaggacgagggacggacgaggtctaagtaacttattactagtaacaagtacaaacganaaccaccttaagttacgttactttaattcgttacgttacgtaacgttcgactaaccggtaacggttccaacccggttcggtcggtaccgaccgaacccggaaacgaaccccaaacccgtntaccgtacctccttacctaccctcccc

SEQ ID NO: 434931 - DNA, 634 bp, Homo sapiens
  misc_feature: GZ8MTXP02GHQ65.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgaccaacccacttattcttattcggtaccagacagaagccaggccacggccctgtgttgtgtaataataataaaagacaacgtagaagaacggccttacgaagggtaactcccgtaggacgacgtattcgtctacggcctacccactacgagggaacctaatcggtacaactagttacgacctactagacgtaggacgtaccaggaacaaggaaacgtagaaggtctacgtaacttaatttctactactaaattcgtttaaacaagtaactacgtacgtagttagttaacgtttacgttacgttacgtacggtaacggtacggtaacgtaacggtaccgtaccgtaccgtacgtaccgaaccgaacccgaaccgaacctaaccctacgtacgtactaccttcctccg

SEQ ID NO: 434932 - DNA, 644 bp, Homo sapiens
  misc_feature: GZ8MTXP02JHAVB.51.81.H04.1.454.CMB.2.raw
  modified_base (236)..(236): a, c, t, g, unknown or other
  modified_base (285)..(285): a, c, t, g, unknown or other
  modified_base (420)..(420): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgtcttattggtaccagcaagaagccggccacggcccctgtgttggngatgtaataaagacacgtgagacggccctgagggtactccctgacgcgtacttctccgtggcctcgaggtcaacggggactacgggtcactagttcgacctatcgagtggacgttccgaggcaaggacggaacgngggtccgtaggtaaccttagtttacgttaggtactaaacgtttaccaaaaccgtagaaccctaaccgtagtttacgttaacctttagttcgtttaccgttacggtaacgtacggtaccgtaaaccggtaaccggttcccgtaaaccgttccggttacggggacctaccgaccccgaacggacccccaacccgtactcggtacctacccgttcgtttacccccgg

SEQ ID NO: 434933 - DNA, 625 bp, Homo sapiens
  misc_feature: GZ8MTXP02HOA47.51.81.H04.1.454.CMB.2.raw
  modified_base (178)..(178): a, c, t, g, unknown or other
  modified_base (241)..(241): a, c, t, g, unknown or other
  modified_base (286)..(286): a, c, t, g, unknown or other
  modified_base (296)..(296): a, c, t, g, unknown or other
tcagcgatcgtatacacgaccggtgctcgatttagtagtgtagattcgcggggctggtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgctcgtggagatgcattcgaccaaaccgntatgcttatggtaccagcagaagccggcagcccctgtgtggtatntagtaaaganactacgagacggaccctacgtaggaatcccgtacgagcgtactccttcgtgtccgtaccgtacggtccgaacgggaccgtaaaccggtacgtaaccgtacgtttacggaccgaacgttaccaggtacggtaggtaccgacggacgaagtacggggacggaacggacgtacgacttaatttacgttagtactaacttacaacaaacggtaacacccgtaattacggttaacttagttagttacgttacgtacgtacgacgtacctaaacgtccgaaccgttccgtacgtccgaccgaaccgaacgacccaccaacctcgtctacttcccg

SEQ ID NO: 434934 - DNA, 589 bp, Homo sapiens
  misc_feature: GZ8MTXP02FJ8BV.51.81.H04.1.454.CMB.2.raw
  modified_base (433)..(433): a, c, t, g, unknown or other
tcagcgatcgtatacacgaccggtgctcgatttagtagtgtagattcgcgggggtgggtccaggaggcagaactctgtgtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgtcttattggtaccagcagaagccgggccaggcccctgtgttggtgatgtataaagacactgagaggccctcgagggactcccgtgagcgtattcctctggctcgaggtcgagggcaacgggtcactagttggctatcaagtggacgtccgaggcgagaggacggagctgacttattagttgtacaatacaanacgacacctattggtaactttaagtcgttacgttacggtaactcggtaccgtaccgtaaacggtcccgaaccggttcccgtacggggtaccaaccggaacccccgaaacgggacccccaaaacccccggtaccttcggtaccctactttcccccgg

SEQ ID NO: 434935 - DNA, 623 bp, Homo sapiens
  misc_feature: GZ8MTXP02H3GLE.51.81.H04.1.454.CMB.2.raw
  modified_base (292)..(292): a, c, t, g, unknown or other
tcagcgatcgtatacacgaccggtgctcgatttagtagtgtagattcgcgggggctgtgggtccaggaggcagaactctgggtgtctcaccatggcctggatccctctacttctcccccctcctcactctctgcacagtctctgaggcctcctatgagctgacacagccaccctcggtgtcagtcgtccccaggacagacggccaggatcactgctctggagatgcattcgaccaaacgatatgtcttatggtaccagcaagaacgccgggccacggcccctggtcgttggngatagtaataaagacactgagacggccctgagggactccccgtaggacgctacttctcgtggacctccgacgggttcgaggggaacctaaacggtcaacgtagttcggcctaatcgaagtcggagtccgaggcaaggtaggacgaaggctagaacttagttattacgactaataccaaacagaacctacgtagttttacggaactttaagtcgtacgttaacggacgttacggaccgaaacccgtaaagggtacccaaccggtttccgtacggggtaccaacggtacccccgaaaagggccccctaaaaccccgcttcggtaacctacccg

SEQ ID NO: 434936 - DNA, 738 bp, Homo sapiens
  misc_feature: GZ8MTXP02ILNHB.51.81.H04.1.454.CMB.2.raw
  modified_base (220)..(220): a, c, t, g, unknown or other
  modified_base (317)..(317): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggcaggatcacctgctcgtgganatgactattcgaccaaaccgattatgtacttagttcggtaccagacaaggaacggcccggaccgacggtcccccgtgtcggttggtagagtagtaanaaagacacgtgaggacggtccctagacgggtactcccgtagacgcgtacttcgccgtggcctacgtaggcgtaggacacgggtcactagttcgacctatacgaggttaggacgtacccgaggaccgaagggaacgggacggacggtacgttacgtaacgttaagtttaagtttacggtaacaaaacttacccgaaagaaccgtaaacccgtaaaccgttaggttttacggttaaacttttacggtccggtttacggttaaaccgggtaactaccgggtaacgtaaaacccggtacgggttacccgtaacccgggtttacccggtacgggtacccgaacccgtaaaccccggaaccggtaaccccccgtaaaacccccgtaacgttcccggtaacctaccctttacccggttttaccccccg

SEQ ID NO: 434937 - DNA, 743 bp, Homo sapiens
  misc_feature: GZ8MTXP02FWUNS.51.81.H04.1.454.CMB.2.raw
  modified_base (216)..(216): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacgcaggatcacctgctctgganatgctattacgaccaaacgatagtgtctttaagtcggtaccagacgaaggaacggccgggaccacgggccccttggtcggttggtagagtagtaaataaacgactacgtggaaggaccggaccctacggaagggtacttacccgtaggacgtcgtaagtttccgtaccgtcggtccgtaccgtaagggtaccggaaacggggaaccgtacggggtcaacgttaggttaccgggcctaacggtcgtaacgggtacgggtaccgtaaccggacggggaacgaagggggaacgggaacgggaacgggtccgttaaaggttaactttaaacgtttaagggttaacgtaacgtaaaacgtaaacctaaaacgaaccggtaaaccctaacccgttaaggtttacgttaacgtttacgttacgtacgtttaacggaacgttacgaccggtaacgtacgtaccgaccggttccgtacggtccacgaacccgaacggacccctaacccgactaccgtacctaccgtccgttacccg

SEQ ID NO: 434938 - DNA, 560 bp, Homo sapiens
  misc_feature: GZ8MTXP02IUTPZ.51.81.H04.1.454.CMB.2.raw
  modified_base (235)..(235): a, c, t, g, unknown or other
  modified_base (326)..(326): a, c, t, g, unknown or other
  modified_base (440)..(440): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccacctcggtgtcagtgtccccaggacagacggccaggatcacctgctctggagatgcattgaccaaaccgntatgcttattggtaccagcagaacgccggcacggcccctgtgtggtgatgtaataaagacacgtgagaggccctagagggactccctggancgtaattctcctggctcgaggtcaggacaggtcaatcgttggccagttacagtggacgtccgaggacaggtaggacgaggactagacttagttaattgtaccaaattccaaaanacgaacaacgtagttacgtattatcgttcgttacgactcggacctaacgtagtccctacgtcgtacggtacaccgaccgaaccgaccccaaacctcgtacgtacctaccgttccgtaccg

SEQ ID NO: 434939 - DNA, 661 bp, Homo sapiens
  misc_feature: GZ8MTXP02FT8DB.51.81.H04.1.454.CMB.2.raw
  modified_base (348)..(348): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatccacctgctctggagatgcattcgaccaaaccgatatgtctttagttcggtaccagacaggaacggcccgggccacggccccgtggtggttggtagtatagtaataaagacatgaggacggcccgtcgagggtactcccgngcgcgtatctcgtcggctcgaggtcgacgggaactaccggcaacgtgtcgacctagtcgaggtgacgtcgaggcgaggacggacggaggtactaggtacgttattacgttagtacaacgtaacaaaccgtaactaaacccgtaaccgttaagtttacggtttaaccgtttagttacggtttaccgttacgggtaaaccgttcggaacccgtaccggaaaccggtcccgtaaccgggttcccgtacggggaccctaccggaaccccgaaccggacccctaacctaccgtcgttacctccgttcctttacccccg

SEQ ID NO: 434940 - DNA, 596 bp, Homo sapiens
  misc_feature: GZ8MTXP02FOOZP.51.81.H04.1.454.CMB.2.raw
  modified_base (220)..(220): a, c, t, g, unknown or other
  modified_base (282)..(282): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattcgaccaaacgatatgtcttatggtaccagcagagccggcacggccctgtgtggtnatgtaataaagacacgtgagcggaccctgaagggactcccgtaggacgcgtactttctccgtggtcctacgaggtcgaacgggaacacggtcacgtagtccgacatcgaagtggacgtacccgaggcgaggagggacgaggtctagtactattagttagtacaatacaaactacgaacacctagttagtaactttgtgttacgttcggaactcgaccgaaccgtaggtacctaccggttccgtacggggtaccaaccgtacccgaaccggaccccctaaaacccgcgttccgtactacccgtccgtttaccccc

SEQ ID NO: 434941 - DNA, 621 bp, Homo sapiens
  misc_feature: GZ8MTXP02G89C3.51.81.H04.1.454.CMB.2.raw
  modified_base (456)..(456): a, c, t, g, unknown or other
  modified_base (465)..(465): a, c, t, g, unknown or other
  modified_base (468)..(468): a, c, t, g, unknown or other
  modified_base (480)..(480): a, c, t, g, unknown or other
  modified_base (490)..(490): a, c, t, g, unknown or other
  modified_base (498)..(498): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtcgtcccaggacagacggcaggactcacctgctcgtggagtatgactattacggaaccaaaccgattatgtactttagttacggtaccagcaagaacggccgggccacgggcccctggttgtggtgtaatggtaactaaaggactacgtaggaaggacggtcccctaggagggtactacccgtggaacgtcgtatttctcgtacgcctacggaggtacgaacgggactacggggtaccactacggttcgacctatcgacggtaggacgtcgaggacgnggagaacgngtntacgattagttntgacttaacnaaacgtanacactagttacgtactttatcggttacgttacgaacgttcggtaaagacccgtaaggtcctaaccggccgttacggaccgacaccgaacgtaccccaaacgtctacgactacgtccgttcccg

SEQ ID NO: 434942 - DNA, 605 bp, Homo sapiens
  misc_feature: GZ8MTXP02JGB9D.51.81.H04.1.454.CMB.2.raw
  modified_base (235)..(235): a, c, t, g, unknown or other
  modified_base (265)..(265): a, c, t, g, unknown or other
  modified_base (277)..(277): a, c, t, g, unknown or other
  modified_base (285)..(285): a, c, t, g, unknown or other
  modified_base (314)..(314): a, c, t, g, unknown or other
  modified_base (454)..(454): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcagatcacctgctgtggagatgcattcgaccaaacgntatgtacttatggtacagcagacgccggcncggcctgtgtgngatgtaanaaagcagtgagacgcctcgagggctccgngagtctacttctccgtcgtcctccgaggtacgagggaacacgggtcacgtagttcgacctatacgagtggacgtaccgagggacgagggaacgggacgacggtactaggtacttaacgtttagttacgtaaccttaaaanaaccgtaagtaaccgtaccgtaacgttacgtttacggttacctttagttacgttccggttaaacgacgtcgaaccgtaccgtaccgtccgtaccggtcggtcgaccgaccggaccgaaccgaccccaaccgtcgtctacctcctctacccg

SEQ ID NO: 434943 - DNA, 641 bp, Homo sapiens
  misc_feature: GZ8MTXP02GLJ1X.51.81.H04.1.454.CMB.2.raw
  modified_base (220)..(220): a, c, t, g, unknown or other
  modified_base (240)..(240): a, c, t, g, unknown or other
  modified_base (437)..(437): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctcgtgganatgctattcgaccaaacgtntatgtacttattcggtaccagcaaggaacggcccgggccgacggccctggtggttggtgatgtaataaagacacgtagacggaccggtccctacggaagggtcctcccgtaggacgtcgtacttctccgtcggcctccgaggtacgacgggaacgaccggtacacgtagttcggactagtcgaggtggacgtaccgnggacgaggaacgggacgagggtctagtaacttattagttcgtataaactacgaaacacgaactacttagttaggttacttatcggttacgtacggtactacgtaccgaacgtacggtaccgtaccggtcggttacggacctaaccggacccgaacggaaccccgaaacccgtcggtactaccgttccgttaccgtttcccccgg

SEQ ID NO: 434944 - DNA, 601 bp, Homo sapiens
  misc_feature: GZ8MTXP02JF4I4.51.81.H04.1.454.CMB.2.raw
  modified_base (240)..(240): a, c, t, g, unknown or other
  modified_base (278)..(278): a, c, t, g, unknown or other
  modified_base (574)..(574): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaaccgntatgtcttatgacagcagagccggcacgccctgtgtgnatgtaataaagacagtagaggcgcctagagggtactccgtgacgcgtattcgccgtcgctaccgaggtacgaaggacgtacggtcaacgtagtcgaccagtcgaggtaggacgtaccgaggacgaggaaggacgtaggactagtaactatttagtacgtaactaaataacaacgaataacctaacgtagtttacggtaatttagtcgttacgtacggaactacggtaccgaaaccgttaaggtcccgaacgttacgggcgtaaccgacggacccgaaaccgtacccgtaaaccccncgtacctaccctaccgttcccgtcccg

SEQ ID NO: 434945 - DNA, 682 bp, Homo sapiens
  misc_feature: GZ8MTXP02I9P21.51.81.H04.1.454.CMB.2.raw
  modified_base (431)..(431): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtccagtcgtccccaggacagacgccaggatcactgctctggagatgctattcgaccaaaccgatatgtcttagttcggtacagcagaacgcccggaccgacggcccctgtcgttggtgatgtataaagacacgtgagacggccctagacgggactccctgacgtcgtacttcgtcgtggtactccgacggttcgacggggaccgaaacggtcctacgtagttcgacctattccgaggttaggacgtcgacggngaacgagggaacgaggaccgttaggaacttaatttacgttacgtaactaaagtacaaaaccgtaacgtaaaccgtaaccctaagtttacgggtaactttacgttacggtttacctaaccgggtaaacgtcggttaaccggaaacccgtaaacggttaccgtacccggtttacccggtacggttaccgaaccgcccccggtaaaacgggaccccctaaaaccccgtaccgttaaccggttctttaaccccgg

SEQ ID NO: 434946 - DNA, 723 bp, Homo sapiens
  misc_feature: GZ8MTXP02GPU8H.51.81.H04.1.454.CMB.2.raw
  modified_base (555)..(555): a, c, t, g, unknown or other
  modified_base (569)..(569): a, c, t, g, unknown or other
  modified_base (709)..(709): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggactcacctgctctggagatgctattgaacccaaacgtatatgcttagttggtaccagcaggaacgccgggccacgggccccctggtggttggtagagttagtaagtaaaacgacgtacctaggacggacggcccctacggacggggtacttccccgtgacggtaccgtactttcgtaccgtcggacccttccggacggggttaccgaacggggaaccgtaccggggttccgaacctacggtttacggggacctaacgttaccgtaaggtcggggtacgttccccggaagggaccgggaaaggaacgggggaacggacgggtcgtaccgtaaattagtttaagttacgttanaaaccttacaaaanacggaaccctaaccttacgttaggtttaacttaacgttcgttaccgtttaacggaaacgttgaccgtaacgtacggtaccctaccggtccgttcgggaccctacggacccgaaccggcccaacccgtactcgttaccccnccgttcccgtcccg

SEQ ID NO: 434947 - DNA, 653 bp, Homo sapiens
  misc_feature: GZ8MTXP02IJKL2.51.81.H04.1.454.CMB.2.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtggagatgctagttcgaccaaacgtatatgtacttagttcggtacctagacagaacggccggccacggcccctgtgttggtgatagtaataaagacactggaagacggccctacgagggactcccgtgacgcgtattctccgtgcctcgaggtcgaacggactacggtacacgtacgttgacctagacgtacggtaggtacgtaccggaggcaaagggtacggaacggaggtctaaggtacttaaagttacgtttaagtacctaaataccgtaaaacacggtaactaaccgttagttacggttaactttagtcgttaacgttacgtacgtacgtaccggaacgtaacggtaccttaccggtacgtaccgggtaacctacggacccgaaccggtacccctaacccgtacgtaccgtacctaccgtttacctttacccccg

SEQ ID NO: 434948 - DNA, 505 bp, Homo sapiens
  misc_feature: GZ8MTXP02FSZC5.51.81.H04.1.454.CMB.2.raw
  modified_base (235)..(235): a, c, t, g, unknown or other
  modified_base (303)..(303): a, c, t, g, unknown or other
  modified_base (385)..(385): a, c, t, g, unknown or other
  modified_base (413)..(413): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgtggtgatgtataaagcatgagaggccctnagggatccctgagcgattctctggctccaggtcaagggacacgggtcacattgccatcaagtggagtccaggcagaggacgnggctagactatattgtacaaatcaaacngaacaccattggtacttatgtctcgaactgacgacaaggtcaccgtctacgggtcacgcccaaggcccaaacccactcgtaccactcttccg

SEQ ID NO: 434949 - DNA, 607 bp, Homo sapiens
  misc_feature: GZ8MTXP02FKHGE.51.81.H04.1.454.CMB.2.raw
  modified_base (252)..(252): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccngcagaagccggcacggcccctgtgttggtgatgtaataaagacacgtgagaggcccctagagggactcccgtgagcgtacttctcccgtggcctcgaggtcgaggggaacaccgggtcacgtagttcgccaatcgaagttcgggagttaccgaggcaaggtaagggacggaaggtctaggtacttaagttattggtacaaatacaaacagaaccaactagtttacggtactttagtgttacgttacggtaacttgaccgtaaccgtaagggtacctaaccggtcgtacggggtacaccgaacccgaacgggacccctaaaccccgacttacggtacctaaccgtccgtttacccg

SEQ ID NO: 434950 - DNA, 684 bp, Homo sapiens
  misc_feature: GZ8MTXP02H6B6S.51.81.H04.1.454.CMB.2.raw
  modified_base (172)..(172): a, c, t, g, unknown or other
  modified_base (218)..(218): a, c, t, g, unknown or other
  modified_base (237)..(237): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctctcactctctgcacaggctctgaggcctctatgagctgacacagccaccctggtntcagtcgtccccaggacagacggccaggactcacctgctcgtgganatgctattcgaccaaacgnttatgtacttagttcggtaccagcaggacggccggccacggccctggtggttggtcgtatgtaataaagacacgtgaggacggtcctagagggtactccgtgacgcgtattctccgtcggcctcgacggtacgaacggggacctacgggtccacgtagttcggacctagtacgtagggtcggacgtaccggagggacgaagggacgggtacggacggtcgtaacggtaactttaagttacgttacggtaaactaaacgttaccgaaagaaccggtaactaacccgttaagtttaacggttaacttttaacgtcggtttacgttaccggtaaaccgttacggtaccgtaaaccgttaaccgggtacctaacccgggttccggttacggtaccgaaccgacccgaaacggaccccaaaccctcgtacgtccctaccgtttccgtccccg

SEQ ID NO: 434951 - DNA, 562 bp, Homo sapiens
  misc_feature: GZ8MTXP02I2OTB.51.81.H04.1.454.CMB.2.raw
  modified_base (379)..(379): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctggagatgcattcgaccaaacgatatcgtcttattcggtacagcaagacggcccgggcacggcccctgtgttggtgatgtaataaagacagtgagacgccctgaggctccgtgacgtcgtacttctacgtcgcctacgaggtacgacgggacaacggtcacgnttacggacctatacgagtaggacgtccgaggcgaggacggtacgagtcgagacttattagtcgtacaatacaacgaacgactaactagttacgtacttagtctacgtacgtactcgaccgacgtaaacggtcctaccgtcgtacggacaaccgaccgaacggacccacctacgtctactaccg

SEQ ID NO: 434952 - DNA, 915 bp, Homo sapiens
  misc_feature: GZ8MTXP02IR7B3.51.81.H04.1.454.CMB.2.raw
  modified_base (243)..(243): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccacccgtggtgtcagtcgtccccaggacaggaccggcaggatcacctgctctggagtatgctattcgaccaaaccgtnttatgtacttagttcggtaccagacaaggaacggcccggaccgacggtcccccgttaggttcggttaggtagtaagtaggtttaaagtaaacgtaaccgtacgttaggaaacggtaccgggtcccccgttacggaacggggtaccttccccggtaggtaccgtcgttaactttccgttacccgtccgggttacccgtccgtaacggggttaccgaaaccggggttaaccgtaaccggggttccaaaccgttacggttccggaaccctagttaccggtagggtacgggtaccgtaccggacgggacgaaacggggaaggggaccggtaacggggttacgttaacggttaaacgtttaacgtttaacgtttacgtaaaccgttaaagttaacccaaaacgtaccggtaaaaccccgtaaccgttaaacggtttttaacggtttaaccgtttaaggtttacccggtttaccggtttaaaaccgggtaccggttacccgggtaaaacccgtaaacccggggttaaaccggggtttccccctaaacccggggttacccggttaccgggggtaaaccccgtaacccggggtaaacccccgtaaacccgggaaccccctaaaacccccgttacgtttacccggtacccctttacccgtttcccccggtttaccccccgg

SEQ ID NO: 434953 - DNA, 495 bp, Homo sapiens
  misc_feature: GZ8MTXP02GEZO5.51.81.H04.1.454.CMB.2.raw
  modified_base (236)..(236): a, c, t, g, unknown or other
  modified_base (280)..(280): a, c, t, g, unknown or other
  modified_base (384)..(384): a, c, t, g, unknown or other
  modified_base (399)..(399): a, c, t, g, unknown or other
  modified_base (406)..(406): a, c, t, g, unknown or other
  modified_base (411)..(411): a, c, t, g, unknown or other
  modified_base (413)..(413): a, c, t, g, unknown or other
  modified_base (417)..(417): a, c, t, g, unknown or other
  modified_base (419)..(419): a, c, t, g, unknown or other
  modified_base (441)..(441): a, c, t, g, unknown or other
  modified_base (453)..(453): a, c, t, g, unknown or other
  modified_base (489)..(489): a, c, t, g, unknown or other
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgttggngatgataaagcacgtgagaggccctgagggatcccgtgagcgattctctggctcgaggtcagggacacggtcacattggacctatcgagtggagtacccagggnaggaggacgaggtcngatattntctananacananacactatgtatatgtgtacgangacgacgagacncgtcgtcgtacgacgacgaacgaccaccactctacnctctcg

SEQ ID NO: 434954 - DNA, 509 bp, Homo sapiens
  misc_feature: GZ8MTXP02I9GD1.51.81.H04.1.454.CMB.2.raw
  modified_base (284)..(284): a, c, t, g, unknown or other
  modified_base (305)..(305): a, c, t, g, unknown or other
  modified_base (317)..(317): a, c, t, g, unknown or other
  modified_base (361)..(361): a, c, t, g, unknown or other
  modified_base (366)..(366): a, c, t, g, unknown or other
  modified_base (375)..(375): a, c, t, g, unknown or other
  modified_base (389)..(389): a, c, t, g, unknown or other
  modified_base (400)..(400): a, c, t, g, unknown or other
  modified_base (402)..(402): a, c, t, g, unknown or other
  modified_base (430)..(430): a, c, t, g, unknown or other
  modified_base (501)..(501): a, c, t, g, unknown or other
tcagcgatcgtatacacgaccggtgctcgatttagtagtgtagattcgcgggggctggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattcgaccaaacgatatgcttatggtaccagcagaagccggcagcccctgtgtgtangtataaagacatagagagccncaggagcctcgngcgctctctgctacgcgtacgacggacgacgacacagtagcganctagngagtcgagngacgagacggagcngactattagtntnaatagacagacacattaggtcttaagtntctcgtacgacgtacgacaacgtacaccgtcgacggttcgaccgaaccgaccgaccaacccgactcgtacnccttaccg

SEQ ID NO: 434955 - DNA, 649 bp, Homo sapiens
  misc_feature: GZ8MTXP02FEKHG.51.81.H04.1.454.CMB.2.raw
  modified_base (172)..(172): a, c, t, g, unknown or other
  modified_base (216)..(216): a, c, t, g, unknown or other
  modified_base (312)..(312): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctctcactctctgcacaggctctgaggcctctatgagctgacacagcccacctggtntcagtcgtcccaggacaggacgcaggactcacctgctcgtggantgactagttcgaaccaaacgtatagttgtacttttagtacgtacgagacgaggacggccggaccgacggcccgtggttggttggtagtatagtaanaaagcagtagagacgtccgacgacggtactccgtagacgctcttctccgtcgtccgtacgacggtacgacggacgacgtactacgtacgtcgactagcgagtacgacgtacgaggacgacgggaagacgagtacgtaacgtattagttacgtacgtaactaaacgtacaaacgaacgtaacgtaacgttacgttacgttaactttacgtacgttacgttaacgtacgtacggaaccgtaacggtacgtaccggtacccgttaccggtacggtaccgaccgtaacccgtaaccggtacccctaacccgtacgttaccgtacctaccgttccgtacccg

SEQ ID NO: 434956 - DNA, 628 bp, Homo sapiens
  misc_feature: GZ8MTXP02FIB66.51.81.H04.1.454.CMB.2.raw
  modified_base (218)..(218): a, c, t, g, unknown or other
  modified_base (235)..(235): a, c, t, g, unknown or other
  modified_base (256)..(256): a, c, t, g, unknown or other
  modified_base (287)..(287): a, c, t, g, unknown or other
  modified_base (305)..(305): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgntatgcttatgtaccagcaganccggcaggccctgtgtgtgatgtaataaagnactgagagccctgagggntcccgtgagcgattctctggctcgaggtcaggggtacacggtcactattcgactatccgaagttggagttacccaggtcaaggaaggacggaggtcaggtaactaagtttaacgttcgtactaaaattaccgaaaacgacggtaaacccaacctaaagtttaccgggtaactttaacgtacgtttaccgttaccggtaaactggtaacccggtaaccgtaaaaggttacccgacccggttaccgttacggggacctaaccggaacccctaaccgggaacccctaacccccgaacgtccggtacctaaccttcgtttaccccgg

SEQ ID NO: 434957 - DNA, 640 bp, Homo sapiens
  misc_feature: GZ8MTXP02GUMJY.51.81.H04.1.454.CMB.2.raw
  modified_base (216)..(216): a, c, t, g, unknown or other
  modified_base (237)..(237): a, c, t, g, unknown or other
  modified_base (295)..(295): a, c, t, g, unknown or other
  modified_base (322)..(322): a, c, t, g, unknown or other
  modified_base (453)..(453): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgngagatgcattcgaccaaacgntatgctttagtgacagcagaacgccggcacggcccctgtgtggtgagtagtaataaanacacgtagacgaggccctgagggtacnccgttgaacgtcgtattcgtcctcggctaccgaggtacgaacgggaactacgggtccactacgttcgacctatccaaggtcggacgtcccggagacgaggaagacggacgtcgtagtaactattacggttntaacgtaaatacgaacgaacgtaaccaccgttaagttaccgttaagtttaacgttcgttaccgttaccggtaaagcggtaaccgaaccggtaaggttaccccgaccggttaccggttacggaccgacccggtaacccgaacggacccctaacccccgtagtccgtaacctccgttacccgttccccg

SEQ ID NO: 434958 - DNA, 710 bp, Homo sapiens
  misc_feature: GZ8MTXP02FZ6J4.51.81.H04.1.454.CMB.2.raw
  modified_base (239)..(239): a, c, t, g, unknown or other
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagatgcattcgaccaaaccgntatgtacttagtcggtaaccagacaagaacgcccggccacggcccctgtcgttggtgatagtaataaagacacgtagagcgcccgtgagggctccgtgacgcgtacttctcgtcggtcctaccgtaggtacgaagggaccacgggtcaacgtacgttcgaccagtaccgtaggtacggacgtaccgaggacgaagggaaggacgaggaccgtaggtaacgttaatttatttacgggtaacctaaagttaacccgaacgtaacgtaaacccgtaacgtttaacgtttacggtttaactttacgtttacggttaccgttaacggtaaacgttcggtaacccggtaaaacccgtaacggttacccgtacccggttaacggtttaccgggtaaccgaaccggtaaccccgaaaccggaacccccgtaaaccccgttaaccgtcggtacccgttaacctcccgttttaaccccccg

SEQ ID NO: 434959 - DNA, 603 bp, Homo sapiens
  misc_feature: GZ8MTXP02JAI14.51.81.H04.1.454.CMB.2.raw
  modified_base (235)..(235): a, c, t, g, unknown or other
tcagcgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagagccggcaggccctgtgtggtgatgtataaagacactgagaggccctcgagggatccctgagccgattctcgtcggctccgaggtcacgggaacacgggtcactagttcggccagtcaagtcggagtccaggcagtaggacgaggtctgactatacttagacctaaagtcaaactacgacctaaccgtaatttcggttaacttaagtcgttaccttacgggaaaactcggtaacgtaaccgtaacggggttccaaacccggttccgtcggggttaccaacgggaccccctaaacgggaccccctaaaacccccggtactccggtacctaacccttcgtttacccccgg

SEQ ID NO: 434960 - DNA, 646 bp, Homo sapiens
  misc_feature: GZ8MTXP02JNO2N.51.81.H04.1.454.CMB.2.raw
  modified_base (221)..(221): a, c, t, g, unknown or other
  modified_base (289)..(289): a, c, t, g, unknown or other
tcagcgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattgtaccagcaagaacgccgggccacggcccctgtcgttggngatgtaataaagacactggagacggcccctacgagggtactccccgtagacgcgtactttctcgtggcctccgaggttcgaggggaccgaaacgggtcaacgtagttacgggacctaagtcgaggttacggacgtcccgaaggccgaaggacggacgacgggctacggaacttagtttattacggtactaagtacaaacaagaacctaaccgtaagtttcggtaactttaattcgttacgttacgggtaaacttggaccggaaacccgtaacgggtacccgaccggttcctacgggggttacaaccggaccccgtaaaccgacccccgaaaacccctccgttacgtacccgtacccg

SEQ ID NO: 434961 - DNA, 536 bp, Homo sapiens
  misc_feature: GZ8MTXP01C4PDB.4.50.E06.1.454.CMB.2.raw
  modified_base (306)..(306): a, c, t, g, unknown or other
  modified_base (328)..(328): a, c, t, g, unknown or other
  modified_base (332)..(332): a, c, t, g, unknown or other
  modified_base (344)..(344): a, c, t, g, unknown or other
  modified_base (370)..(370): a, c, t, g, unknown or other
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgacccagtctcctccacctgtctgcatctgtaggagacagagtcaccttcacttgccgggccagtcagactgtagcacattgctgtatcagcagaaccagcaaagccccagaactctgatctttgatgcctcatttggacgnggtgggtcccatcaaaggttcngcgnagtggatctganacagaattcactctacaccatcaacncgacctgacagcctgatgatgttacgactaacttactacgtacgacccaaactagtaacgttgggttcgggttccctttcgttcccgggtggggttcccggtttcggggaccccgggggtaacaaacggggtcggtaaaatccgaaaacgtaaccgttggtaacgg

SEQ ID NO: 434962 - DNA, 609 bp, Homo sapiens
  misc_feature: GZ8MTXP01AHFZM.4.50.E06.1.454.CMB.2.raw
  modified_base (203)..(203): a, c, t, g, unknown or other
  modified_base (277)..(277): a, c, t, g, unknown or other
tcagagcactgtagcacgaccggtgctcgatttagatctactgacaacacacaagggggcaggagtcagactcagtcaggacacagcatggacatgagggtccccgctcagctcctgggctcctgctgctctggctcccaggtgccaactgtgacatccagatcgacccagtcctccttccaccctgtctgcatctgtagganacagatcaccttcacgttcggccgggcagtcagtactgttagcacatttcggcctggtatcagacaagaaaccnggaccaaacgccccaagaacctcctagtacttctttgatcgcccttacgtacgtttgggacgtcggtcggggtacccagtcgtaaaacgggttcaaggcggcgaggtcgatcgtagagactagtaacttcacttccacaaccataccaacgtacgcctgacctacgccgtaggactaggtattacggtcgaacttaacctttacgtacttcgaacctaaacgtgttaacgttcgggttcggttcccgttcggtccgggtcggggttccgggttcccggggacccgggaaccggtaaggtaacggaaacgtacgaaacgtaacgttggtaacg

SEQ ID NO: 434963 - DNA, 561 bp, Homo sapiens
  misc_feature: GZ8MTXP01DZ76F.4.50.E06.1.454.CMB.2.raw
  modified_base (203)..(203): a, c, t, g, unknown or other
  modified_base (401)..(401): a, c, t, g, unknown or other
  modified_base (423)..(423): a, c, t, g, unknown or other
  modified_base (447)..(447): a, c, t, g, unknown or other
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgacccagtcctccttccaccctgtctgcatctgtagganacagagtcaccttcacttgccgggcagtcagactgttagtcacatttggcctggtatcagcaagaaaccaggacaaacgccccagaactcctgatctttgatgcctcactttggacgaggtcggggtcccagtcgaaaacgggttcaaggcggcaggtggatcgtgaagacagaacttcactctacaaccatacaacncgcctgcagcctgatgatgttnactaacttactactcgacctaacnggttaatcggttggttccctttcgtccgggttcgggggttccggtttccggggaccccgggggtaaccgaaagggttaacggaaaactacgaaacggtaacgttggtaaccggg

SEQ ID NO: 434964 - DNA, 555 bp, Homo sapiens
  misc_feature: GZ8MTXP02HRRHH.4.50.E06.1.454.CMB.2.raw
  modified_base (401)..(401): a, c, t, g, unknown or other
  modified_base (403)..(403): a, c, t, g, unknown or other
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgacccagtcctccttccacctgtctgcatctgtaggagacagagtcaccttcacttggccgggccagtcagactgttagcacctatttggcctggtatcagcaagaaaccaggacaaacgccccaagaacctctgatctttgatcgcctcctacgtttggacgtacggtcggggtcccagtcgaaggttcaggcggcaggtgatcgtgagacagtaattcactctacacatacaacncncctgacacgcctagatgtattgtacgacctaacttactactgaccaagtagttacgtcggttgttccttcggtcccggtcggggtccggttccgggacccggggtaaccgtaacgggtacggtaaacgtacgaaaacgtacgtacggtacgg

SEQ ID NO: 434965 - DNA, 539 bp, Homo sapiens
  misc_feature: GZ8MTXP02FV6IT.4.50.E06.1.454.CMB.2.raw
  modified_base (215)..(215): a, c, t, g, unknown or other
  modified_base (269)..(269): a, c, t, g, unknown or other
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgacccagtctccttccacctgtctgcatctgtaggagacagagtcaccttnacttgccggccagtcagactgtagtcaccattggcctggtatcagcagaaaccnggcaaagccccagaactctgatctttgatcgcctctactttggacgagtggggtcccagtcaaggttcaggcggacagtcggatcgtgagacagtaaattcactctcacatacaacagcctgcagcctagatgatgttagactaacttactactcgaccaagtagttacgtggtcggttcctttcgtccgggtcggggtccggtttaccggggacccggggaaccgtaaagggtacggtaaaacgtacgaaaaccgtaacgtggtacggg

SEQ ID NO: 434966 - DNA, 532 bp, Homo sapiens
  misc_feature: GZ8MTXP02HNEDE.4.50.E06.1.454.CMB.2.raw
  modified_base (202)..(202): a, c, t, g, unknown or other
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgacccagtctccttccaccctgtctgcatctgtagganacagagtcaccttcacttgccggcagtcagactgtagtcaccattggcctggtatcagcagaaaccaggcaaagcccagaactctgatctttgatgcctcctacgtttggacgtagtcggggtccctagtcgaagggttcaggcgggacagtggtatcgtagagacagtaatcactctcacatcaacagcctgacagcctgtatgacttgttcgactaacttacgtactacgaccaaactagtactgggttcgttccttccgtcggtccgggtcggtccgggcccggggaaccgtaggtacggaaacgtacgaaacgacgttaggtacgg

SEQ ID NO: 434967 - DNA, 530 bp, Homo sapiens
  misc_feature: GZ8MTXP02JUK95.4.50.E06.1.454.CMB.2.raw
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgacccagtctccttccaccctgtctgcatctgtaggagacagagtcaccttcacttgccgggccagtcagactgtagtcaccattggcctggtatcagcagaaccaggcaaacgcccagactctgatctttgatcgcctccactttggacgagtggggtcccatcaaggttcagcggcagtgatctgagacagaaattcactctcaccatcaacagcctgacagcctgatgatgttcgactaacttacacttcgacctaaacgagttagtcggttcggttcccttcggtccggttcggggtccggttaccggggcccgggggaacgtaaacgggtacgggaaaactacgaaacgtaacgtggtcgg

SEQ ID NO: 434968 - DNA, 585 bp, Homo sapiens
  misc_feature: GZ8MTXP02FQR8Y.4.50.E06.1.454.CMB.2.raw
  modified_base (202)..(202): a, c, t, g, unknown or other
  modified_base (267)..(267): a, c, t, g, unknown or other
  modified_base (405)..(405): a, c, t, g, unknown or other
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgacccagtcctccttccacctgtctgcatctgtagganacagagtcacttcacttgccggcagtcagtactgtagcactattggcctggtatcagcagaaccngacaacgcccagactctgactcttgactcgcctctacgtttggacgtacggtcgggtcccagtcgaaggttcagggcggactaggtggtactcgtaggacacgaagtaaacttcaactctaccaaccactacaaaccncgccctagaccgaacgtcctagattgtacgttagtacgtactaaacttacgtaactcgaacctaagtgttaacgttcgggttcggttcccttcggttccgggtcggggttccggttcccggggaccggggtaaaccgtaagggtaacggaaaacgtacgaaaacggtaacgtcggtacgg

SEQ ID NO: 434969 - DNA, 580 bp, Homo sapiens
  misc_feature: GZ8MTXP02JG2CS.4.50.E06.1.454.CMB.2.raw
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgacccagtctccttccaccctgtctgcatctgtaggagacagagtcaccttcacttgccggccagtcagtactgttagtcactatttggcctggtatcagcaagaaaccaggacaaacgccccaagaacctctgtatcttgacttcgcctcacgtttggacgtacggtcggggtacccagttcgtaaacggttcagggcggtacgaggtaggacttcgagacgacgaagtaacttccacttctaccaccactaccaactacgcctgactacgcctgatgattgtacactaacttacactcacctagtaagtagttcggttcgttcccgttcggtccgggttcgggtaccgggttcccgggacccggggtaacgaacgggtacggtaaacgaccgtaaacggtaacgtcggtaccgg

SEQ ID NO: 434970 - DNA, 567 bp, Homo sapiens
  misc_feature: GZ8MTXP02HEAA3.4.50.E06.1.454.CMB.2.raw
  modified_base (216)..(216): a, c, t, g, unknown or other
  modified_base (265)..(265): a, c, t, g, unknown or other
  modified_base (278)..(278): a, c, t, g, unknown or other
  modified_base (288)..(288): a, c, t, g, unknown or other
  modified_base (390)..(390): a, c, t, g, unknown or other
  modified_base (453)..(453): a, c, t, g, unknown or other
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgaccagtctccttccaccctgtctgcatctggtaggagacagagtcaccttnacttggccggccagtcagactgtagcacagttgctgatcagcaagaacngacaaacgcccanaactctgatnttgatcgacctcgagtttggacgtaggtcggggtcccagtacgtaaggttcgagcggcagtgatcgagaagacagtaacttcactctaccacataccaaacncgactcgacgaacgcctagacgtagagtttagacgtacctaaactttacacctcgaacctaanaaggttatcgggttcgttaccgtcggtcccggtacgggtccggttcccgggggtacccgggaaccggtaacgggtaacgtaaacgtaacggtaaaacgtaaccggtagtaccgg

SEQ ID NO: 434971 - DNA, 631 bp, Homo sapiens
  misc_feature: GZ8MTXP02JG9VF.4.50.E06.1.454.CMB.2.raw
  modified_base (275)..(275): a, c, t, g, unknown or other
tcagagcactgtagcacgaccggtgctcgatttagatctactgacaacacacaagggggcaggagtcagactcagtcaggacacagcatggacatgagggtccccgctcagctcctggggctcctgctgctctggctcccaggtgccaactgtgacatccagatgacccagtctccttccaccctgtcctgcatctgtaggagacagagtccaccttcacttgccggccagtcagactgtagtcacctattggcctggtactcagcaagaaaccnggacaaacgccccaagaacctcctagacttctttgatcgccttacctaagtttcggacgtaacggtcggggtacccctaagtcgtaaaacgggttcacgggtccggagtaggttgaacttcgagaaacgtacgagtaaacttcaactactaccgaactactaaccgaaacacgtaccgtgaccggacgtccctagacgtagtattacggtaacgtaactaaacctttacgtactcgaacctaacgtaagttacgttggtaccggttccgttccgtacgggtcgggtaccggttaccggggacccggggaacgtaaacgggtacggtaaaactacggaaaacgtacggtaggtacgg

SEQ ID NO: 434972 - DNA, 511 bp, Homo sapiens
  misc_feature: GZ8MTXP01EGX1P.44.75.G09.1.454.CMB.2.raw
  modified_base (494)..(494): a, c, t, g, unknown or other
  modified_base (508)..(508): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatcttttctggatccactttgaagagtggagcccagccaggttcagcggcagtggttctggggacacatttcactctcacccatcagcagcctgccagcctggagatttcgcgtaacttattactgaccaaactaatattctttttatccgttactagtttggccaggggtaccaagctggagatacaaagactggtggctgcaccatctgtctcatcctcccgcctaatcttgattatatacttgttcttgngcggctggcagcgnaag

SEQ ID NO: 434973 - DNA, 517 bp, Homo sapiens
  misc_feature: GZ8MTXP01B7U2W.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtccccagccaggttcagcggcagtggtctgggacacatttcactctcaccatcagcagcctgccagcctggagatttcgcgaacttattactgccaaactaattattctttttatccgttactagttttggcctagggggacccaagctggagatcaaaggactgggtggctgcaccatctgtcttcatcttcccgcaatcttgattatatacttgttcttgaagcgggctgggcaaggcgcaag

SEQ ID NO: 434974 - DNA, 503 bp, Homo sapiens
  misc_feature: GZ8MTXP01D2P6A.44.75.G09.1.454.CMB.2.raw
  modified_base (499)..(499): a, c, t, g, unknown or other
tcagacagtatatacacgaccggtgctcgatttagtatagacatcagggacttaggggctttgccaggctcctgctgctctgtttcccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggtctggggacacatttcactctcaccatcagcagcctgccagctggagatttcgcgcttattactgccaacaatatctttttatccgtacagtttgccaggggaccaagctggagatcaaagactggtggctgcaccatctgtcttcatcttcccgcaatcttgattatatacttgttcttgaagcgggctggcaaggccgngaag

SEQ ID NO: 434975 - DNA, 509 bp, Homo sapiens
  misc_feature: GZ8MTXP01DVNHL.44.75.G09.1.454.CMB.2.raw
  modified_base (506)..(506): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtccccagccaggttcagcggcagtggttctgggacacatttcactctcaccatcagcagcctgccagcctggagatttcgcgtcttattacctgacccaacaatattctttttatcgtactagtttgcctaggggaccaagctggagatcaaaggactgggtgctgcaccatctgtcttctatcttcccgcaatcttgattatatacttgttcttgaagcgggctggcaggcgnaag

SEQ ID NO: 434976 - DNA, 509 bp, Homo sapiens
  misc_feature: GZ8MTXP01ASP1H.44.75.G09.1.454.CMB.2.raw
  modified_base (250)..(250): a, c, t, g, unknown or other
  modified_base (474)..(474): a, c, t, g, unknown or other
  modified_base (489)..(489): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtccccagccaggttcagcggcagtggtctgggacacatttcactctcaccatcagcagcctgccagctggagatttcgcgtcttattactgaccaacaattattctttttatccgttactagtttggccaggggaccaagctggagatacaaaggactggtggctgcaccatctgtcttcatcttcccgctaatcttgattntatacttgttcttgngcgggctggcaggcgcgaag

SEQ ID NO: 434977 - DNA, 534 bp, Homo sapiens
  misc_feature: GZ8MTXP01BC6WL.44.75.G09.1.454.CMB.2.raw
  modified_base (249)..(249): a, c, t, g, unknown or other
  modified_base (496)..(496): a, c, t, g, unknown or other
  modified_base (532)..(532): a, c, t, g, unknown or other
  modified_base (534)..(534): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatctttcnggatccactttgaagagtggagtccccagccaggttcagcggcagtggttctgggacacatttcactctcaccatcagcagcctgccagcctggatatttcgcgtaacttattactgaccaaactaattactttctttttatccgttactaggttttcggaccgtaggggacccaagtctagggagatacgaaaggtactagggtggctgacaccatctgtcttctactccttcccgcctaatcttntattatatacttgttcttgaagcggctggcaggcgngn

SEQ ID NO: 434978 - DNA, 515 bp, Homo sapiens
  misc_feature: GZ8MTXP01ED8WV.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtccccagccaggttcagcggcagtggtctgggacacatttcactctcaccatcagcagcctgcccagctggagtatttcgcgtaacttattactgaccaactaattattctttttatccgtactagtttggcagggacaagctggagatacgaaagactgggtggctgcaccatctgtcttcattccttcccgcctaatcttgattatatacttgttcttgtaagcgggctggcaggcgcaag

SEQ ID NO: 434979 - DNA, 663 bp, Homo sapiens
  misc_feature: GZ8MTXP01DW49S.44.75.G09.1.454.CMB.2.raw
  modified_base (250)..(250): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtcccagccaggttcagcggcagtggtctgggacacatttcactctcaccatcagcagcctgccagctggatactttcgcgtaacttattactcgacctaactaattatttccttttttactccgttactaaggtttttcggaccgtaagggggaaccctaaaggccgttagggaagtaacgtaccgaaaagggtaaccgttgggggtacgggtccttacggacccgtaaccctacgttccttcggtttaccctttccgtaaccgtttcccctttcccccggccccttaatttcccttaggtaactttaagttaacttaaccgttcggttcccgttagggtaacgggccgggggtccgttaggggaccgttaaacggggtccgaaccgtaag

SEQ ID NO: 434980 - DNA, 521 bp, Homo sapiens
  misc_feature: GZ8MTXP01D7FQW.44.75.G09.1.454.CMB.2.raw
  modified_base (250)..(250): a, c, t, g, unknown or other
  modified_base (482)..(482): a, c, t, g, unknown or other
  modified_base (486)..(486): a, c, t, g, unknown or other
  modified_base (518)..(518): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtcccagccaggttcagcggcagtggttctgggacacatttcactctcaccatcagcagcctgccagctggatatttcgcgtaactttattaactgacccaacaattattcttttttatccgttactagttttggccaggggtaccaagctggagatacgaaaggactggggtgctgcaccatctgtcttctatccttcccgccaatcttnattntatacttgcttgaagcgggctggcagggccgnaag

SEQ ID NO: 434981 - DNA, 558 bp, Homo sapiens
  misc_feature: GZ8MTXP01B26VZ.44.75.G09.1.454.CMB.2.raw
  modified_base (343)..(343): a, c, t, g, unknown or other
  modified_base (554)..(554): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaagcccctaagtccctgatctttctggatccactttgaagagtggagcccagccaggttcagcggcagtggttctgggacacatttcactctcaccatcagcagcctgccagcctgganatttcgcgtaacttatactcgaccaactaattatttactttttatccgttactaggttttcggaccgtagggggtaaccaaggtctagggaagatacgaaaagggtactaggggtcggtcgtcgaccaccattcgttgttaccttctacttccttccccgcctaatccttgtattatatacttgttcttggaagcgggctgggcaggccgntaag

SEQ ID NO: 434982 - DNA, 511 bp, Homo sapiens
  misc_feature: GZ8MTXP01DV4VM.44.75.G09.1.454.CMB.2.raw
  modified_base (251)..(251): a, c, t, g, unknown or other
  modified_base (345)..(345): a, c, t, g, unknown or other
  modified_base (452)..(452): a, c, t, g, unknown or other
  modified_base (466)..(466): a, c, t, g, unknown or other
  modified_base (469)..(469): a, c, t, g, unknown or other
  modified_base (474)..(474): a, c, t, g, unknown or other
  modified_base (490)..(490): a, c, t, g, unknown or other
  modified_base (492)..(492): a, c, t, g, unknown or other
  modified_base (510)..(511): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcgcttgccgggcgagtgccgacattaggacttttttggcctggtttcagcaggagcctggcaaagcccctaagtccctgatcttttcnggatccactttgaagagtggagccccagccaggttcagcggcagtggttctgggacacatttcactctcaccatcagcagcctgccagctgganatttcgcgtaacttatactgaccaaactaatattctttttatccgttatagtttggctaggggaccaagctggagatacgaaagaactgggtggctgcaccatcttntctctctcctcccnctntcttntattatatcttgttcngngcggcgtggacgacgcgnn

SEQ ID NO: 434983 - DNA, 612 bp, Homo sapiens
  misc_feature: GZ8MTXP01DISST.44.75.G09.1.454.CMB.2.raw
  modified_base (306)..(306): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggtcagcgcagtggtctgggacanatttcactctcaccatcagcagcctgccagctggagtatttcgcgtaactttattactgaccaaactaattattacttttttatcccgttaactaggttttcggaccgtaagggggtaacccaaaggtcgttagggaagagtaacgaaaagggtaaacgttggggtacgggtcttggacctaaccctaagttccttcggttcctttctaacttccctttccccgcctaacttccttgttacttattaaccgttgttaccgttggacgggtcggggtccgttggggaccgaaagggcgtcgaataag

SEQ ID NO: 434984 - DNA, 534 bp, Homo sapiens
  misc_feature: GZ8MTXP01EKFDI.44.75.G09.1.454.CMB.2.raw
  modified_base (252)..(252): a, c, t, g, unknown or other
  modified_base (274)..(274): a, c, t, g, unknown or other
  modified_base (533)..(533): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgatcttttcnggatccactttgaagagtggancccagccaggttcagcggcagtggttctgggacacatttcactctcaccatcagcagcctgccagcctggagtactttcgcgtaacttattacctgacccaaactaattactttcttttttactccgttactagttttggccagggggtaccaagctaggagatacaaaggactgggtggctgcacagtctgtacttctattccttcccgccaatcttgattatactacttgttcttgaagcgggctggcgagccgaang

SEQ ID NO: 434985 - DNA, 513 bp, Homo sapiens
  misc_feature: GZ8MTXP01CH9WX.44.75.G09.1.454.CMB.2.raw
  modified_base (250)..(250): a, c, t, g, unknown or other
  modified_base (268)..(268): a, c, t, g, unknown or other
  modified_base (335)..(335): a, c, t, g, unknown or other
  modified_base (364)..(364): a, c, t, g, unknown or other
  modified_base (446)..(446): a, c, t, g, unknown or other
  modified_base (511)..(511): a, c, t, g, unknown or other
  modified_base (513)..(513): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatcacttgagagtgancccagccaggtcagcgcagtggtctggacacatttcactctcaccatcagcagcctgccagctgganatttcgcgtaacttattactgacccaaanaattattctttttatccgtatagtttgccgtaggggaccaagctaggagatacgaaagaactgggtggtctgcacctatctntacttctactccttcccgctaactcttgtattatatacttgttcttgaagcggtctggcaggcgngn

SEQ ID NO: 434986 - DNA, 511 bp, Homo sapiens
  misc_feature: GZ8MTXP01DTTN4.44.75.G09.1.454.CMB.2.raw
  modified_base (469)..(469): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggtctgggacacatttcactctcaccatcagcagctgccagctggagatttcgcgtaacttattactgccaacaattattctttttatccgttactagtttggccaggggaccaagctggagatcaaaggaactgggtggctgcacatctgtcttcattcttcccgcaatcngtattatatacttgttcttgaagcgggctgggcaggcgcgaa

SEQ ID NO: 434987 - DNA, 512 bp, Homo sapiens
  misc_feature: GZ8MTXP01DANH8.44.75.G09.1.454.CMB.2.raw
  modified_base (345)..(345): a, c, t, g, unknown or other
  modified_base (457)..(457): a, c, t, g, unknown or other
  modified_base (466)..(466): a, c, t, g, unknown or other
  modified_base (475)..(475): a, c, t, g, unknown or other
  modified_base (494)..(494): a, c, t, g, unknown or other
  modified_base (500)..(500): a, c, t, g, unknown or other
  modified_base (510)..(510): a, c, t, g, unknown or other
  modified_base (512)..(512): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctggggacacatttcactctcaccatcagcagctgccagctgganatttcgcgtaacttattactagaccaactaattattactttttatccgtactagtttggccgtaggggacaagctaggagatacaaagactggtagctgacacatctgtctntactctccnctaatcttnattatatacttgttcttgngtcggntggcaggcgngn

SEQ ID NO: 434988 - DNA, 530 bp, Homo sapiens
  misc_feature: GZ8MTXP01A259S.44.75.G09.1.454.CMB.2.raw
  modified_base (249)..(249): a, c, t, g, unknown or other
  modified_base (430)..(430): a, c, t, g, unknown or other
  modified_base (479)..(479): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttnggatccactttgaagagtggagtcccagccaggttcagcggcagtggtctggggacacatttcactctcacccatcagcagcctgccagctggatatttcgcgtaacttattacctgaccaaactaattactttctttttatccgttactagttttcggccgaggggaccagcgtggaganagaaagactgggtgctgacacatctgtctctatcctccgctaatcgttnattatactacttgttcttggtaagcgggtaactggacgaaggccgaagaag

SEQ ID NO: 434989 - DNA, 526 bp, Homo sapiens
  misc_feature: GZ8MTXP01EBKNH.44.75.G09.1.454.CMB.2.raw
  modified_base (356)..(356): a, c, t, g, unknown or other
  modified_base (504)..(504): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgagagtggagcccagccaggttcagcggcagtggttctgggacacatttcactctcaccatcagcagcctgccagccggagatttcgcgacttnttactgccaacaattatcttttatcgtactagtttggcagggacaacgctggagatacaaaggaactagtggggcttgcaccatctgttcttactactccttccccgccctatcttgatattagtacttggttccttggagtcggggntcgggcgaagggcgtcaataag

SEQ ID NO: 434990 - DNA, 513 bp, Homo sapiens
  misc_feature: GZ8MTXP01DROQ7.44.75.G09.1.454.CMB.2.raw
  modified_base (422)..(422): a, c, t, g, unknown or other
  modified_base (495)..(495): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctggggacacatttcactctcaccatcagcagcctgccagcctggagtatttccgcgtaacttattactgacccaaactaatattctttttatccgtactagtttgcagggaccaagctgganatacaaagaactggtggctgcacatctgtcttctactccttcccgctaatcttgtattatatcttgttcttgngcggctgcgaggcgcgaa

SEQ ID NO: 434991 - DNA, 520 bp, Homo sapiens
  misc_feature: GZ8MTXP01EEM8V.44.75.G09.1.454.CMB.2.raw
  modified_base (482)..(482): a, c, t, g, unknown or other
  modified_base (492)..(492): a, c, t, g, unknown or other
  modified_base (500)..(500): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtccccagccaggttcagcggcagtggttctggggacacatttcactctcacccatcagcagcctgccagcctggagatttccgcgtaactttattactgaccaactaattattcttttttatccgttactagtttggccagggtaccaagctggagatagaaagaactggtggctgcaccatctgtcttcatccttcccgcaatcttnattatatacngttcttgngcgggctggcgaggcgcgaa

SEQ ID NO: 434992 - DNA, 589 bp, Homo sapiens
  misc_feature: GZ8MTXP01AHFFQ.44.75.G09.1.454.CMB.2.raw
  modified_base (302)..(302): a, c, t, g, unknown or other
  modified_base (584)..(584): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttcnggggacacatttcactctcaccatcagcagcctgccagctggacatttcgcgtaactttatactgccctaaataacttacttactttttttactccgtttaactaaggtttttcgggaccgtaagggggaaccctaaaggtccttagggaagaagttaccgaaaagggtaactggggtaggcgttcgactaccattcttcgttcctttctacttccctttccccgcctaactccttatacttattatacttgttcttggaacgcgggctggcgaacgggtcncgaag

SEQ ID NO: 434993 - DNA, 652 bp, Homo sapiens
  misc_feature: GZ8MTXP01BQNYN.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattctttctggatccactttgaagagtggacgtcccagccaggttcagcggctagtggttctgggacactatttcactctcaccatcagcacgcctgccacggctggatacttccgcgtaactttattactgaccctaaataattactttactttttactccgttacgttaggtttcggaccgtacggggtaaccaggtacgtagggaacgtaacgtaacgtaaaacgggtaacgtgggggttacgggcttacggaccctaccgtaacttccgttcgttaccctttacctacctttccctttccccggcccttaacgttccttaggtaaccttagttaacttaaccgttgttccgttagggtaacggtccggggtcttcggggacgttaacgggtcccggttaacgtaag

SEQ ID NO: 434994 - DNA, 518 bp, Homo sapiens
  misc_feature: GZ8MTXP01BVB0Y.44.75.G09.1.454.CMB.2.raw
  modified_base (345)..(345): a, c, t, g, unknown or other
  modified_base (429)..(429): a, c, t, g, unknown or other
  modified_base (485)..(485): a, c, t, g, unknown or other
  modified_base (518)..(518): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgccagctgganatttcgcgtaacttattactgacccaaactaattacttcttttttatccgttactagttttggccgaggggaccaagctagganatacaaagaactgggtggctgcacatctgtcttctatctcccgctaatcttgattntatacttgttcttgaagcggctggcaggcgaan

SEQ ID NO: 434995 - DNA, 517 bp, Homo sapiens
  misc_feature: GZ8MTXP01ETIWG.44.75.G09.1.454.CMB.2.raw
  modified_base (250)..(250): a, c, t, g, unknown or other
  modified_base (345)..(345): a, c, t, g, unknown or other
  modified_base (423)..(423): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagccccagccaggttcagcggcagtggttctgggacacatttcactctcacccatcagcagcctgccagctgganatttcgcgtaacttattactgacccaaataattattctttttatccgttactagtttggccaggggaccaagctgganatacaaaggaactgggtgctgcaccatctgtcttctactccttcccgcaatcttgattatatacttgttcttgaagcgggctggcaggcgcaag

SEQ ID NO: 434996 - DNA, 519 bp, Homo sapiens
  misc_feature: GZ8MTXP01CT3JT.44.75.G09.1.454.CMB.2.raw
  modified_base (250)..(250): a, c, t, g, unknown or other
  modified_base (301)..(301): a, c, t, g, unknown or other
  modified_base (502)..(502): a, c, t, g, unknown or other
  modified_base (519)..(519): a, c, t, g, unknown or other
tcagacagtatatacacgaccggtgctcgatttagtatagacatcagggacttaggggctttgccaggctcctgctgctctgtttccccggtgccaggtgtgacatctagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtcccagccaggttcagcggcagtggttcngggacacatttcactctcaccatcagcagcctgccagcctggagatttcgcgtaacttattactgaccaacaattacttcttttttatccgttactagttttggccagggggacctaagctaggagatacaaaggaactgggtggctgcaccatctgtcttctatccttcccgcaactcttgattatatacttgttcttgngcggctggcaggcgaan

SEQ ID NO: 434997 - DNA, 547 bp, Homo sapiens
  misc_feature: GZ8MTXP01CH62L.44.75.G09.1.454.CMB.2.raw
  modified_base (249)..(249): a, c, t, g, unknown or other
  modified_base (528)..(528): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaagcccctaagtccctgatctttcnggatccactttgaagagtggagccccagccaggttcagcggcagtggttctgggacactatttcactctcaccatcagcagcctgcccaggccgagactttcgacgtacttaattactagaccctaaacaatttacttcttttttactccgttactaggttttcggaccgtaaggggacctaagtcgtagggagagttacgaaaggactggtggggctgccacatctcgtcttctactccttcccgcctatctgatattatactgttcgttgagcgggntcggcaaggcgcaagtaag

SEQ ID NO: 434998 - DNA, 539 bp, Homo sapiens
  misc_feature: GZ8MTXP01A3L52.44.75.G09.1.454.CMB.2.raw
  modified_base (253)..(253): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgtatcttttcnggatccactttgaagagtggagtcccagccaggttcagcggcagcggttctgggacacatttcactctcaccatcagcagcctgcccagcctggacgtatttcgcgtaacttatacctgaccaaactaattactttctttttactccgttactagtttcggaccgtaggggaccaagcgtaggagactacgaaagtactgggtgctgacacagtctgtctctactcctcccgcaatcttgtattatatacttgttcttggtaacggcgggctgggcgaggcgcaag

SEQ ID NO: 434999 - DNA, 514 bp, Homo sapiens
  misc_feature: GZ8MTXP01AFJ1R.44.75.G09.1.454.CMB.2.raw
  modified_base (250)..(250): a, c, t, g, unknown or other
  modified_base (266)..(266): a, c, t, g, unknown or other
  modified_base (306)..(306): a, c, t, g, unknown or other
  modified_base (467)..(467): a, c, t, g, unknown or other
  modified_base (495)..(495): a, c, t, g, unknown or other
  modified_base (511)..(511): a, c, t, g, unknown or other
  modified_base (513)..(513): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagngtggatcccagccaggtcagcggcagtggtctgggacacntttcactctcaccatcagcagcctgccagctggagtatttcgcgtaacttattactgaccaaactaattactttctttttatccgttactgtttcggccgaggggaccaagcgtggagatacaaagactggggtggctgcacatctgtctctatcctcccncaatcttgattatatacttgttcttggngcgggctggcaggcgngng

SEQ ID NO: 435000 - DNA, 521 bp, Homo sapiens
  misc_feature: GZ8MTXP01BSQNH.44.75.G09.1.454.CMB.2.raw
  modified_base (251)..(251): a, c, t, g, unknown or other
  modified_base (266)..(266): a, c, t, g, unknown or other
  modified_base (272)..(272): a, c, t, g, unknown or other
  modified_base (290)..(290): a, c, t, g, unknown or other
  modified_base (443)..(443): a, c, t, g, unknown or other
  modified_base (490)..(490): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggacaaagcccctaagtccctgatctttcnggatccatttgaagngtggancccagccaggtcagcggnagtgtctggacacatttcactctcaccatcagcagcctgccagctggagtatttcgcgtaacttattacctgaccaactaattacttctttttatccgtatagtttcgacaggggaccagctgggatatacgaaagactgggtggctgcaccntctgtcttctatccttcccgctaatcttgtattatacttcttgttcngaacggcgggcgtgggcgaaggccgaagaag

SEQ ID NO: 435001 - DNA, 516 bp, Homo sapiens
  misc_feature: GZ8MTXP01AWGPN.44.75.G09.1.454.CMB.2.raw
  modified_base (301)..(301): a, c, t, g, unknown or other
  modified_base (366)..(366): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccatccaggttcagcggcagtggttcnggggacacatttcactctcaccatcagcagcctgccagcctggagatttcgcgtaacttattacngcccaaacaattattctttttatccgtactagtttggtcaggggaccaagctggagatacaaaggactgggtggctgcaccatctgtcttcatccttcccgcaatcttgattatatacttgttcttgaagtcgggctggcagggcgcgaa

SEQ ID NO: 435002 - DNA, 520 bp, Homo sapiens
  misc_feature: GZ8MTXP01EHR16.44.75.G09.1.454.CMB.2.raw
  modified_base (250)..(250): a, c, t, g, unknown or other
tcagacagtatatacacgaccggtgctcgatttagtatagacatcagggacttaggggctttgccaggctcctgctgctctgtttccccggtgccaagtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatcactttgaagagtggagtcccagccaggttcagcggcagtggtctgggacacatttcactctcacatcagcagcctgccagctggagatttcgcgtcttattactgaccaactaatatttcttttttactccgttactagtttcggccaggggtaccaagtctggagatacgaaaggaactgggtggctgcaccatctgtcttctactcttcccgcaatcttgacttatatacttgttcttgaaggcgggctggcagggcgcgaag

SEQ ID NO: 435003 - DNA, 654 bp, Homo sapiens
  misc_feature: GZ8MTXP01EMHG5.44.75.G09.1.454.CMB.2.raw
  modified_base (296)..(296): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtgagtcccagccaggtcagcgcagtgtcnggacacattcactctcaccatcagcagcctgccagcctggatactttacgacgtaacttattactagacctaaactaacttatttcttttttaactaccgttaactaggttttcggaccgtaagggggtaaccaaaggtcgtagggaagtaacgtacgtaaaacgggaaccgttaggggtcggggtacttcggaccgtaacccgtaacttccgttcggtttacctttacctaaccttccccggtttacccccgcccttaaacttccttaggtaatttaaccgttaaattaaccttgttccgttagggaacggtccgggggtcgttcggggacccgttaaagggtccggaaccgttaag

SEQ ID NO: 435004 - DNA, 516 bp, Homo sapiens
  misc_feature: GZ8MTXP01B9QM5.44.75.G09.1.454.CMB.2.raw
  modified_base (446)..(446): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgcccagcctggagatttcgcgtctttattactgaccaactaattattcttttttatccgttactagtttggccaggggaccaagctggagatacaaagactgggtgctgcacntctgtcttctatccttcccgcaactcttgacttatatcttgttcttggaagcgggctggcaggcgcgtaa

SEQ ID NO: 435005 - DNA, 521 bp, Homo sapiens
  misc_feature: GZ8MTXP01BLFMG.44.75.G09.1.454.CMB.2.raw
  modified_base (253)..(253): a, c, t, g, unknown or other
  modified_base (275)..(275): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattcttttcnggatccactttgaagagtggancccagccaggttcagcggcagtggttctgggacacatttcactctcaccatcagcagcctgcccagctggatactttcgcgtaacttattactgaccaaactattattcttttatcgtatgtttgcagggaccagctaggagatacgaaaggtaactgggtaggctgaccactatcttgtcttctactccttcccgctaactcttgattatactattgttcttggaagcgggctggcaggcgcaag

SEQ ID NO: 435006 - DNA, 528 bp, Homo sapiens
  misc_feature: GZ8MTXP01B5FWC.44.75.G09.1.454.CMB.2.raw
  modified_base (251)..(251): a, c, t, g, unknown or other
  modified_base (346)..(346): a, c, t, g, unknown or other
  modified_base (485)..(485): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggactccactttgaagagtggagtcccagccaggttcagcggcagtggttctgggacacatttcactctcaccatcagcagcctgccagctgganatttcgcgtcttattactgaccaactaattattccttttttatccgttactacgtttggccgtaggggtaccaagtctggagatacgaaaggactggggtggctgcaccatctgttcttctatcttcccgctaatcttnattatatacttgttcttgaagcgggcgtggcgaggcgcgtaag

SEQ ID NO: 435007 - DNA, 521 bp, Homo sapiens
  misc_feature: GZ8MTXP01CNIGX.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggtctgggacacatttcactctcaccatcagcagcctgcccagcctggagatttcgcgtaacttattactgaccaacaattacttcttttttatccgttactagttttggccaggggaccaagctggagatacaaaggactgggtggctgcaccatctgtccttctatccttcccgctaatcttgattatatacttgttcttgaagcgggtctggcaggcgcgaag

SEQ ID NO: 435008 - DNA, 568 bp, Homo sapiens
  misc_feature: GZ8MTXP01BZ3ID.44.75.G09.1.454.CMB.2.raw
  modified_base (258)..(258): a, c, t, g, unknown or other
  modified_base (555)..(555): a, c, t, g, unknown or other
  modified_base (563)..(563): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtgccgacattaggtacttttttggccttggtttcagcaggagcctggacaaagccccttaagtccctgtattcttttcnggattccactttgaagagtggagtcccagccaggtcagcgcagtgtctgggacacatttcactctcaccatcagcagcctagccagctggagtactttcgacgtcttattactgacctaaactaattactttctttttactccgttactacggttttcggaccgacggggtaaccaagtcgtaggaagtaactacgaaagggtaacctggggtacggtctagaccacctatccttgttacttctacttcccttcccgcctaattcttgtattatactacttgttcttgaagcggtcnggcaggcngtaag

SEQ ID NO: 435009 - DNA, 525 bp, Homo sapiens
  misc_feature: GZ8MTXP01CYF7R.44.75.G09.1.454.CMB.2.raw
  modified_base (373)..(373): a, c, t, g, unknown or other
  modified_base (524)..(524): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaagcccctaagtccctgatctttctggatccactttgaagagtggagtccccagccaggtcagcggcagtggttctgggacacatttcactctcaccatcagcagcctgccagcctggacatttcgcgtaacttattactgacccaaanaattatctttttactccgtactagttttggcctaagggggaccaaggctagggagatcaaaggaactggtggactgacaccatcctgtcttcattccttcccgctaatcttgattattatcttgttcttgaagcggctggacaggcgaagng

SEQ ID NO: 435010 - DNA, 504 bp, Homo sapiens
  misc_feature: GZ8MTXP01ERNTK.44.75.G09.1.454.CMB.2.raw
  modified_base (250)..(250): a, c, t, g, unknown or other
  modified_base (344)..(344): a, c, t, g, unknown or other
  modified_base (447)..(447): a, c, t, g, unknown or other
  modified_base (460)..(460): a, c, t, g, unknown or other
  modified_base (463)..(463): a, c, t, g, unknown or other
  modified_base (468)..(468): a, c, t, g, unknown or other
  modified_base (477)..(477): a, c, t, g, unknown or other
  modified_base (487)..(487): a, c, t, g, unknown or other
  modified_base (494)..(494): a, c, t, g, unknown or other
  modified_base (496)..(496): a, c, t, g, unknown or other
  modified_base (502)..(502): a, c, t, g, unknown or other
  modified_base (504)..(504): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtcccagccaggtcagcggcagtggttctggggacacatttcactctcaccatcagcagcctgccagctgganatttcgcgtaacttatactgaccaaactaattattctttttatccgtactagtttgccaggggaccaagctgagatacaaagactggtggctgcaccatcttntctctctcctccnctntcttntattatatnttgttcttgngcggcgngngagcgngn

SEQ ID NO: 435011 - DNA, 708 bp, Homo sapiens
  misc_feature: GZ8MTXP01CYOZW.44.75.G09.1.454.CMB.2.raw
  modified_base (306)..(306): a, c, t, g, unknown or other
  modified_base (309)..(309): a, c, t, g, unknown or other
tcagacagtatatacacgaccggtgctcgatttagtatagacatcaggggtctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgccggcccaggacagagcgtcgccatctcctgctctaggaaacaactcaacattggtctaatcatgttacataggtaacaaaagtcgctggctcggacccctaaagtcctcatttanganaatctagacgccactcgatctctgaccgtaattctctcgcctactaagtctaggtaacttcacgtcctaactttcggaccctacttacccgaacccgggtacctacccgaacggtaacccgtagggaacgaaccggtaacgggtacccggtaaacgttttaaccgttaagtttcgggttacggggttccgttacgggggtaacccttacccggtacggttcccgggtttggggttcgggggttttcggggggtttttaaccgggaccgggggttaaccggggtaaccccggaccgtttacggggtaaccccgttacccggttaaacggttacccggtaacggtaccccgaaacgggtcccgtacccgggttcccccccgttcgggttcccttaaccccg

SEQ ID NO: 435012 - DNA, 633 bp, Homo sapiens
  misc_feature: GZ8MTXP01CDFL0.44.75.G09.1.454.CMB.2.raw
  modified_base (250)..(250): a, c, t, g, unknown or other
  modified_base (309)..(309): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtccccagccaggttcagcggcagtggttctggggacncatttcactctcaccatcagcagcctgccagcctggagatttcgcgtaacttattactgaccctaaataattattctttttttaactccgttaactacggtttttcgggaccgtaagggggtaaccccaaggtccgtagggagtatacgtaaagggtaaccgttggggtacggtcgttcggaccaccctatcgttcgttcctttcctacttccctttcccccgccctaacttccgttagtattacgttaacgttaacccttgttccgttgggtaacgggccgggggtaacgttcggggaccgaaacggggtccgaaccgtaagg

SEQ ID NO: 435013 - DNA, 512 bp, Homo sapiens
  misc_feature: GZ8MTXP01BXKKR.44.75.G09.1.454.CMB.2.raw
  modified_base (250)..(250): a, c, t, g, unknown or other
  modified_base (347)..(347): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtccccagccaggttcagcggcagtggttctggggacacatttcactctcaccatcagcagcctgccagcctgganatttcgcgaacttattactgaccaactaattattctttttatccgttactagtttggcctaggggaccaagctggagatacaaagactgggtggctgcacatctgtctcatctcccgcaatcttgattatatacttgttcttgaagcgggctggcaggcgctaag

SEQ ID NO: 435014 - DNA, 536 bp, Homo sapiens
  misc_feature: GZ8MTXP01D5HI8.44.75.G09.1.454.CMB.2.raw
  modified_base (250)..(250): a, c, t, g, unknown or other
  modified_base (416)..(416): a, c, t, g, unknown or other
  modified_base (449)..(449): a, c, t, g, unknown or other
  modified_base (464)..(464): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtcccagccaggttcagcggcagtggtctggggacacatttcactctcaccatcagcagcctgccagcctggagatttcgcgtcttattactgaccaaactaatattctttttatccgtactagtttgcagggaccaagctgganatacaaaggaactgggtaggctgcaccatcttntctctactcctcccnctaatcttagtaattatacttacttgttcgttaggaacggtcgggtcgtacgggacgaaggtcgaacgtaag

SEQ ID NO: 435015 - DNA, 504 bp, Homo sapiens
  misc_feature: GZ8MTXP01EDYUS.44.75.G09.1.454.CMB.2.raw
  modified_base (251)..(251): a, c, t, g, unknown or other
  modified_base (263)..(263): a, c, t, g, unknown or other
  modified_base (267)..(267): a, c, t, g, unknown or other
  modified_base (295)..(295): a, c, t, g, unknown or other
  modified_base (408)..(408): a, c, t, g, unknown or other
  modified_base (455)..(455): a, c, t, g, unknown or other
  modified_base (463)..(463): a, c, t, g, unknown or other
  modified_base (480)..(480): a, c, t, g, unknown or other
  modified_base (488)..(488): a, c, t, g, unknown or other
  modified_base (504)..(504): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatctttcnggatcattgagngtgnccagcagtcagcgcagtgtctgggacantttcactctcaccatcagcagcctgccagctggatagtttcgcgtaacttattactgaccaactaattattctttttatccgttatagtttgccgtaggggaccagctagganagtacaaagactagggtgctgacacatctagttctctattcctcccnccaattcntattatattacttgttnttgaaggngcgtgcagggcgaagn

SEQ ID NO: 435016 - DNA, 518 bp, Homo sapiens
  misc_feature: GZ8MTXP01DSR7S.44.75.G09.1.454.CMB.2.raw
  modified_base (476)..(476): a, c, t, g, unknown or other
  modified_base (478)..(478): a, c, t, g, unknown or other
  modified_base (517)..(517): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattctttctggatccactttgaagagtggagtcccagccaggttcagcggcagtggttctggggacacatttcactctcacccatcagcagcctgccagctggatatttccgcgtaactttattactgaccaacaattattctttttatcgtactagttttggccgaggggaccagctggagatacaaagactgggtggctgcacatctgtacttctatccttcccgctaatcntnttatatacttgttcttgaagtcgggctggcaggcgaagng

SEQ ID NO: 435017 - DNA, 515 bp, Homo sapiens
  misc_feature: GZ8MTXP01BDOJV.44.75.G09.1.454.CMB.2.raw
  modified_base (482)..(482): a, c, t, g, unknown or other
  modified_base (513)..(514): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggtctgggacacatttcactctcaccatcagcagcctgccagctggatatttcgcgtaactttattactgaccctaacaattattcttttttatccgttactagttttggccaggggaccaagctggagatacaaagactgggtggctgcaccatctgtcttcatccttcccgcaatcttgattntatacttgttcttgaagcggctggcaggcgnng

SEQ ID NO: 435018 - DNA, 595 bp, Homo sapiens
  misc_feature: GZ8MTXP01CPQS0.44.75.G09.1.454.CMB.2.raw
  modified_base (300)..(300): a, c, t, g, unknown or other
  modified_base (523)..(523): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggacaaagcccctaagtccctgatctttctggatccactttgaagagtggagtcccagccaggtcagcggcagtggtcngggacacatttcactctcaccatcagcagcctgccagctggatatttcgacgtaacttattactacgaccaaactaatttactttccttttttactccgttaacttacggttttcggacccgtaacgggggtaacctaaacggtcgtagggtagagtaacgaaacggtaactggggtacgggtctacgacaacctatccttgttccttctacttcccttcccncctaattcttagtattagtacttacttgttcgttggtaacggcgggtcgtcgggcgaacgggtccgcgtaag

SEQ ID NO: 435019 - DNA, 511 bp, Homo sapiens
  misc_feature: GZ8MTXP01E4M86.44.75.G09.1.454.CMB.2.raw
  modified_base (345)..(345): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggttcagcaggagcctggcaaagcccctaagtccctgatcttttctggatccacttgaagagtggagtccccagccaggttcagcggcagtggttctggggacacatttcactctcaccatcagcagcctgcccagctgganatttcgcgaacttatactgccaaacaattattctttttatccgtactagtttggcctaggggaccaagctggagatacaaagactgggtggctgcaccatctgtctctatctcccgccaatcttgattatatacttgttcttgaagcgggctggcaaggcgctaag

SEQ ID NO: 435020 - DNA, 528 bp, Homo sapiens
  misc_feature: GZ8MTXP01A0WA6.44.75.G09.1.454.CMB.2.raw
  modified_base (255)..(255): a, c, t, g, unknown or other
  modified_base (302)..(302): a, c, t, g, unknown or other
  modified_base (310)..(310): a, c, t, g, unknown or other
  modified_base (481)..(481): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaagcccctaagtccctgtattctttcnggatccactttgaagtagtggatccccagccaggtcagcgcagtgtntgggacanatttcactctacaccatcagcagctgccagctggatattcgcgtcttatactgaccaatattattctttttatccgttaacgtagttttcggaccgtaggggtaccaagtcgtagagatacgaaagactgggtgctgacaccgatctagtctctacttcctcccgcaatcngtattatatacttgttcttggaaggtcgggtctggacgagtcgcaag

SEQ ID NO: 435021 - DNA, 818 bp, Homo sapiens
  misc_feature: GZ8MTXP01CUTW9.44.75.G09.1.454.CMB.2.raw
  modified_base (252)..(252): a, c, t, g, unknown or other
  modified_base (256)..(256): a, c, t, g, unknown or other
tcagacagtatatacacgaccggtgctcgatttagtatagacatcaggggtctgcttcagctgtgagcgcagaaggcaggactcgggacaatcttcatcatgacctgctcccctctcctcctcacccttctcattcactgcgcagggtcctgggcccagtctgcattgacgcagcccgccctcagtgtctgccggcccaggacagagcgtcgccatctcctgctctaggaaacactccaacattggtctaancatntacatagtaacaaaagtcgctggctaccggacccctaaagtcctactatttatgtaagaacttcttaacgaccggtcccacgtcggactctcgtacgaccgtaactttcctcgttcgcccttacgtaaacgtccttacgggaacctttccgaacgtcccttacgtttcggacccctaacgtcccgtaaaccccggtacccttacccgaacggtaacccttaaggggaacgtaaccgggtaacgggtacccggggtttaaattttaaccggtttaacgtttgggggtttacggggtacccgttttaacggggggtaccccttaacccggttacggggtttccccgggtttaggggggtttcgggggttttccggggggggttttttaacccgggggacccgggggttaacggggggttaaaccccccgttacgggttacccggggtaaccccggtttacccgtttaaacgggttaccccgaacccgggttaccccggaaacccgggttcccgttaccccgggttaccccccccgtttccggggttaaccctttaacccccggg

SEQ ID NO: 435022 - DNA, 531 bp, Homo sapiens
  misc_feature: GZ8MTXP01B2ZDH.44.75.G09.1.454.CMB.2.raw
  modified_base (250)..(250): a, c, t, g, unknown or other
  modified_base (302)..(302): a, c, t, g, unknown or other
  modified_base (486)..(486): a, c, t, g, unknown or other
  modified_base (509)..(509): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtccccagccaggttcagcggcagtggttcnggggacacatttcactctcaccatcagcagcctgccagcctggatatttccgcgtaacttattacctgacccaaactattattcttttttatccgttactagtttcggccagggggaccaagctggagatacgaaaggactggggtgctgcacatctgtcttcacttccttccccgcctaatcngtacttatatacttgttcttggnggcgggctggcgaggcgcgtaa

SEQ ID NO: 435023 - DNA, 532 bp, Homo sapiens
  misc_feature: GZ8MTXP01CI2QB.44.75.G09.1.454.CMB.2.raw
  modified_base (253)..(253): a, c, t, g, unknown or other
  modified_base (527)..(527): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagccccctaagtccctgattcttttcnggatccactttgaagagtggagtcccagccaggttcagcggcagtggttctggggacacatttcactctcaccatcagcagcctgccagctggagtatttcgcgtaacttattactgaccaaactaattattctttttatccgtatacgtttggcctaggggacctaagctggagatacaaagactggtggctgccacatctgttaccttctattcctcccgctaactcttgtattataatacttgttcttggtaagcgggctgggcaagggcncgaag

SEQ ID NO: 435024 - DNA, 612 bp, Homo sapiens
  misc_feature: GZ8MTXP01DCHHY.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttctggatcctactttgaagagtggagtccccagcccaggttcagcggcagtggttctgggacacatttcactctcaccatcagcagcctgcccagcctggatactttcgacgtaacttattactcgaccaaactaattactttactttttatccgttatagttttcggccgtaagggggacccaaggtcgtaggaagtagtaacgaaaagggtaacgttggggtcggtcgttacgaccctacctacgttccttgtttccttcctaacttcccctttccccgacctaacttccttagtaattaacgttactaacttcgttacgttggaacggtcgggtccgtggacgaagggtccgaacgtaag

SEQ ID NO: 435025 - DNA, 521 bp, Homo sapiens
  misc_feature: GZ8MTXP01CI4C0.44.75.G09.1.454.CMB.2.raw
  modified_base (251)..(251): a, c, t, g, unknown or other
  modified_base (347)..(347): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtccccagccaggttcagcggcagtggtctgggacacatttcactctcacccatcagcagcctgccagcctggantttcgcgtaacttattactgccaaacaattattcttttttatccgttactagttttggccaggggaccaagctggagatacgaaaggactagggtggactgcaccatctgtcttctatcttcccgctaatcttgtattatatacttgttcttgaagcgggctggcaggcgcgaa

SEQ ID NO: 435026 - DNA, 502 bp, Homo sapiens
  misc_feature: GZ8MTXP01ACPJQ.44.75.G09.1.454.CMB.2.raw
  modified_base (250)..(250): a, c, t, g, unknown or other
  modified_base (469)..(469): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcagagcccctaagtccctgatctttcnggatccactttgaagagtggagtcccagccaggttcagcggcagtggtctgggacacatttcactctcaccatcagcagcctgcagcctggagaatttcgcgacttatactgccaacattatctttttatccgtactagttttggcctaggggaccaagctggagatcaaaggaactgtggctgcaccatctgtcttcatccttcccgcctattcctgntatattacttgttctgagcggcgtgcgaagcgc

SEQ ID NO: 435027 - DNA, 532 bp, Homo sapiens
  misc_feature: GZ8MTXP01CEIH7.44.75.G09.1.454.CMB.2.raw
  modified_base (366)..(366): a, c, t, g, unknown or other
  modified_base (462)..(462): a, c, t, g, unknown or other
  modified_base (495)..(495): a, c, t, g, unknown or other
  modified_base (500)..(500): a, c, t, g, unknown or other
  modified_base (515)..(515): a, c, t, g, unknown or other
  modified_base (527)..(527): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattctttctggatccactttgaagagtggagtccccagccaggttcagcggcagtggttctggggacacatttcactctcacccatcagcagcctgcccagccggagactttcgacgtactttntactgacccaaactaattattcttttttataccgttactagttttcggccgaggggacccaagctggacatacaaaggactgtggggctgacaccntctgtcttcactccttcccgccatctgatattntactnttcgttgacgcgggntcggcaggcgcngtaag

SEQ ID NO: 435028 - DNA, 518 bp, Homo sapiens
  misc_feature: GZ8MTXP01AKI4D.44.75.G09.1.454.CMB.2.raw
  modified_base (251)..(251): a, c, t, g, unknown or other
  modified_base (346)..(346): a, c, t, g, unknown or other
  modified_base (479)..(479): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtccccagccaggttcagcggcagtggttctgggacacatttcactctcaccatcagcagcctgccagctgganatttcgcgtaacttatactgaccaataattattctttttatccgtactagttttggccaggggaccaagctggagatacaaaggtaactgggtaggctgcaccatctgttctctatcttcccgctaatcttgnttatatacttgttcttgaagcgggctgggcaggcgcaag

SEQ ID NO: 435029 - DNA, 595 bp, Homo sapiens
  misc_feature: GZ8MTXP01A9XJG.44.75.G09.1.454.CMB.2.raw
  modified_base (256)..(256): a, c, t, g, unknown or other
  modified_base (550)..(550): a, c, t, g, unknown or other
  modified_base (567)..(567): a, c, t, g, unknown or other
  modified_base (594)..(594): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgtattcttttcnggacttccactttgaagagtggacgtccccagccaggttcaggcggcaggtggtctgggacactatttcactctcacatcagcagctgccagcgtggactactttcgacgtaacttattacctacgacctaaactaattactttctttttacttaccgttacttacggtttcggaccgtaacggggaacctaagtcgtagggaacgtaagtaaccggaaaaggtaccgttagggggttacggcttacggaccacctatcttacgttcttctacttcccttcccgcctaatcttntattatatacttgttcngtaaggcgggctagggcagggcgaagng

SEQ ID NO: 435030 - DNA, 535 bp, Homo sapiens
  misc_feature: GZ8MTXP01C30VF.44.75.G09.1.454.CMB.2.raw
  modified_base (439)..(439): a, c, t, g, unknown or other
  modified_base (455)..(455): a, c, t, g, unknown or other
  modified_base (462)..(462): a, c, t, g, unknown or other
  modified_base (470)..(470): a, c, t, g, unknown or other
  modified_base (481)..(481): a, c, t, g, unknown or other
  modified_base (484)..(484): a, c, t, g, unknown or other
  modified_base (531)..(531): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgattcttttctggatccactttgaagagtgagtcccagccaggttcagcggcagtggttctgggacacatttcactctcaccatcagcagcctgcccagcctggatatttccgcgtaactttattacctgacccaaataattatttcttttttatccgttactaggttttcggccgtaggggacagctaggagatanaaaggactaggtcggntgcaccntctgtctntactcctcccnctntcttgtattatatcttgttcgttgaaggcggcgtggcgttaggccgngaag

SEQ ID NO: 435031 - DNA, 515 bp, Homo sapiens
  misc_feature: GZ8MTXP01BVEF3.44.75.G09.1.454.CMB.2.raw
  modified_base (251)..(251): a, c, t, g, unknown or other
  modified_base (454)..(454): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgccagctggagtatttcgcgtcttatactgacccaataattattctttttatccgttatagtttgccgaggggaccaagctaggagatacgaaagacgtggtggctgcacatctgtcttntactccttcccgcaatcttgattatatattgttcttggaagcgggctgggcaggcgcgaag

SEQ ID NO: 435032 - DNA, 539 bp, Homo sapiens
  misc_feature: GZ8MTXP01D6Y0V.44.75.G09.1.454.CMB.2.raw
  modified_base (524)..(524): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtccccagccaggttcagcggcagtggttctgggacactatttcactctcaccatcagcagcctgccagctgaagtattttagactaacttattactgtcagtctaagtttaactaccttaccctctctacgtttcggacggtacgggacctaagggtggagaactaacgaaacgtaactggggtggctgacaccatctgtcttctacttccttcccgctaatcttgtattatatacttgttcttgaagcggngtggcgaggcgcgaa

SEQ ID NO: 435033 - DNA, 612 bp, Homo sapiens
  misc_feature: GZ8MTXP01DZMIY.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattctttctggacttccactttgaagagtggacgtcccagccaggttcagcggcagtggttctgggacacatttcactctcacccatcagcagcctgccagctgagtactttcgcgtaacttattacctacgaccaaactaattatttacttttttactccgttacttacgttttcggacccgtaagggggaaccctaaaggtctagggagaactacgaaaggtaacgtggggtacggtcttcgacaacccttcttcgttcgttaccttctaccgttccctcccgtcctaacttcttagtaattacgttacgttacgttcgttcgttagggtaacgggtcggggtcgtacgggacggacggtcgcgtaag

SEQ ID NO: 435034 - DNA, 528 bp, Homo sapiens
  misc_feature: GZ8MTXP01CRDLI.44.75.G09.1.454.CMB.2.raw
  modified_base (252)..(252): a, c, t, g, unknown or other
  modified_base (348)..(348): a, c, t, g, unknown or other
  modified_base (364)..(364): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggtactccactttgaagagtggagtcccagccaggttcagcggcagtggttctgggacacatttcactctcaccatcagcagcctgccagctggantttcgcgtcttatacngaccaatattattctttttatcgttactagtttggccgaggggacagctaggagatacaaagactggtcggctgacacctagtctagtcttctacttccttcccgcctaatccttgtacttatatacttgttcttcgtaaggcgggtctgggcaaggcgcgtaa

SEQ ID NO: 435035 - DNA, 562 bp, Homo sapiens
  misc_feature: GZ8MTXP01DBR97.44.75.G09.1.454.CMB.2.raw
  modified_base (254)..(254): a, c, t, g, unknown or other
  modified_base (436)..(436): a, c, t, g, unknown or other
  modified_base (506)..(506): a, c, t, g, unknown or other
  modified_base (516)..(516): a, c, t, g, unknown or other
  modified_base (541)..(541): a, c, t, g, unknown or other
  modified_base (546)..(546): a, c, t, g, unknown or other
  modified_base (561)..(561): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaagcccctaagtccctgattctttcnggatcctacttgaagagtggacgtcccagccaggtcaggcggcagtggtctggacactatttcactctcaccatcagcagcctgcccagctaggagtactttcggactaacttattactgacctaaacaattactttctttttaactccgttattacgttttggccgtaaggggaccaagtntaggaagataacgaaagggtaactgggggtcgcgtgaccactactcgttgttccttctacttccttcccncctaatcttnattacgttatacttgttcttgaagnggtcnggcagggtccgaagng

SEQ ID NO: 435036 - DNA, 530 bp, Homo sapiens
  misc_feature: GZ8MTXP01AFUP9.44.75.G09.1.454.CMB.2.raw
  modified_base (253)..(253): a, c, t, g, unknown or other
  modified_base (486)..(486): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgtattcttttcnggactccactttgaagagtggagtcccagccaggttcagcggcagtggttctggggacacatttcactctcaccatcagcagcctgccagctggagatttcgcgtcttatactgaccaactaattatttcttttttatccgttactagttttggccgtaggggacccaagcgtagggagatacgaaaggtactgggtcggctcgcaccatctgtcttctattccttcccgctntcttgattatatacttgcttgaaggcgggcgtggcaggcgcaag

SEQ ID NO: 435037 - DNA, 734 bp, Homo sapiens
  misc_feature: GZ8MTXP01AVA2I.44.75.G09.1.454.CMB.2.raw
  modified_base (252)..(252): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatcttttcnggatccactttgaagagtggagtcccagccaggttcagcggcagtggttctgggacactatttcactctcaccatcagcagcctgcccagctaggatactttcgcgtaactttacttacctcgaccctaaactaactttacttttaccttttttaacgtcccgtttaacgttacgggtttttcgggaccggtaacgggggtaaccctaaacggtccgttaaggggtaacgtaacgttaaaccggtaaaacgggtaaccgttaggggggttacgggtaccgttaccgggaaccccgtaacccgtaactttcccgtttcggttttaccctttacccgttaaccctttcccccgttacccccggtaccctaaccgtttacttaccggttaactttaaacgtttaactttaacccgtttggttccgttggggtaaccggggccggggtaacgttcggggacccggttaagggcccgttaacgtaag

SEQ ID NO: 435038 - DNA, 532 bp, Homo sapiens
  misc_feature: GZ8MTXP01EWZ9Z.44.75.G09.1.454.CMB.2.raw
  modified_base (349)..(349): a, c, t, g, unknown or other
  modified_base (432)..(432): a, c, t, g, unknown or other
  modified_base (483)..(483): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgtattcttttctggactccactttgaagagtggagtccccagccaggttcagcggcagtggttctgggacacatttcactctcaccatcagcagcctgccagctgatntttcgcgtcttatactcgacctaactaattatttactttttactccgttactagtttcggaccgaggggtaccaagctagganatacgaaagaactgggtgctgacaccatctcgtcttctacttccgttcccncaatcttgattatatacttgttcttggaagcggtctggacaggcgcgaa

SEQ ID NO: 435039 - DNA, 540 bp, Homo sapiens
  misc_feature: GZ8MTXP01C69Q1.44.75.G09.1.454.CMB.2.raw
  modified_base (460)..(460): a, c, t, g, unknown or other
  modified_base (491)..(491): a, c, t, g, unknown or other
  modified_base (536)..(536): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgattctttctggactccactttgaagtagtggagtcccagccaggttcagcgcagtggttctgggacacatttcactctcacccatcagcagctgccagcctggagtactttcgcgtcttattactcgaccaaacaattattctttttactccgttactagttttggaccgtaggggacagctggagtatacgaaagtactggggtcggctgacacntcttgttcttcgtacttcctcccgctaatcngtacttattatcttagttcttggaacggcggcgtcggcgagtcgngaag

SEQ ID NO: 435040 - DNA, 521 bp, Homo sapiens
  misc_feature: GZ8MTXP01COHMU.44.75.G09.1.454.CMB.2.raw
  modified_base (347)..(347): a, c, t, g, unknown or other
  modified_base (425)..(425): a, c, t, g, unknown or other
  modified_base (480)..(480): a, c, t, g, unknown or other
  modified_base (486)..(486): a, c, t, g, unknown or other
  modified_base (500)..(500): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattctttctggatccactttgaagagtggagtccccagccaggttcagcggcagtggttctgggacacatttcactctcaccatcagcagcctgccagctgganatttcgcgtaacttatactgaccaactattactcttttttatcgttactagttttggccgaggggacaagtctagganatacaaaggaactggggtgctgccacctatctgtcttctatcctcccgctaatcngtattntatcttgttcttgngtcggctggcacggcgcgtaa

SEQ ID NO: 435041 - DNA, 541 bp, Homo sapiens
  misc_feature: GZ8MTXP01A6T9O.44.75.G09.1.454.CMB.2.raw
  modified_base (465)..(465): a, c, t, g, unknown or other
  modified_base (485)..(485): a, c, t, g, unknown or other
  modified_base (490)..(490): a, c, t, g, unknown or other
  modified_base (510)..(510): a, c, t, g, unknown or other
  modified_base (537)..(537): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgtattcttttctggactccactttgaagagtggagcccagccaggttcaggcggctaggtggttctgggacacatttcactctcaccatccagcagcctgccagcctggagtatttcgcgtaacttatactgaccaaactaattattctttttatccgttatagtttcggccgaggggaccaagctaggagatacaaaggactgggtggctgcaccatcgtntctctactccttcccgcctntcttntattatacgttacttgttcnggtaacggcgggtcgtggcgaagccgngtaa

SEQ ID NO: 435042 - DNA, 539 bp, Homo sapiens
  misc_feature: GZ8MTXP01A5995.44.75.G09.1.454.CMB.2.raw
  modified_base (251)..(251): a, c, t, g, unknown or other
  modified_base (485)..(485): a, c, t, g, unknown or other
  modified_base (496)..(496): a, c, t, g, unknown or other
  modified_base (535)..(535): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggacgtcccagccaggtcagcggcagtggtctgggacacatttcactctcaccatcagcagcctgccagcctggagtatttcgcgtcttattactgaccctaaataattatttcttttttactccgttactagtttcggaccgtaggggaacctaagctaggagatacgaaaggaactggggtggactgacacatctgtccttctactccttcccncctaagtcttnattatatacttgttcttgaaggcggctgggcaaggccgngaag

SEQ ID NO: 435043 - DNA, 559 bp, Homo sapiens
  misc_feature: GZ8MTXP01CEP1T.44.75.G09.1.454.CMB.2.raw
  modified_base (342)..(342): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtgagtcccagccaggttcagcggcagtggtctgggacacattcactctcaccatcagcagcctgccagctgganatttcgcgtaacttattactgaccaaactaattattctttttactccgttactagttttcggaccgtaggggaacctaaggcgtaggagtacgtacgaaaggaactgggtcggctcgcaccattctgttaccttctacttccttcccgcctaactcttgtattattactaacttcgttcttggtaacggcgggtcgtcgggcgaagggtcgcgtaag

SEQ ID NO: 435044 - DNA, 728 bp, Homo sapiens
  misc_feature: GZ8MTXP01DP4DR.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgattctttctggattccactttgaagagtggagtcccagccaggttcagcggcaggtggttctgggacactatttcactctcacccatcagcagcctgccaggctggagtactttcgcgtctttatttacctcgaaccctaaactaattacttttccttttttactacccgtttacgttacggttttacgggacccgtaaggggggtaacccctaaaggtcccgttaaggggaacggtaaacgttaaccggtaaaaaacggggtaacgtttcggggggtacggggtaccgtttccggacccgtaacccgtaactttcccgttcggtttacctttacccgttaaccgtttcccccgtttaccccgaccctaactttcccttaggtaaacttttaacgttaactttaacccgttggtttccgttaggggaaccgggttccgggggtcgttacgggggaccgttaaacggggtcccggaacgtaagg

SEQ ID NO: 435045 - DNA, 579 bp, Homo sapiens
  misc_feature: GZ8MTXP01AJJJZ.44.75.G09.1.454.CMB.2.raw
  modified_base (375)..(375): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgtattcttttctggatccactttggaagaggtggacgtcccagccaggtcaggcggcagttggtctgggacactatttcactctcaccatcagcagcctgccagctggatattcgacgtaacttataccgngacctaactattactttctttttactccgttactaggtttcggacaggggtacagtcgtggatatacgaaagacgtggggtagcgtgacctactagttcgtgttacctttctacttcccttccccggctaacttcttagtattaacgttataccgttgttccgttggaacggtcgggtaacgcgggcgaacgggcgaacgtaag

SEQ ID NO: 435046 - DNA, 667 bp, Homo sapiens
  misc_feature: GZ8MTXP01AIJ2O.44.75.G09.1.454.CMB.2.raw
  modified_base (300)..(300): a, c, t, g, unknown or other
  modified_base (373)..(373): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttggaagagtggagtcccagccaggttcagcgcagtggtcngggacacatttcactctcaccatcagcagcctgccagctggagtatttcgcgtaacttattactgaccctaanaattatttcttttttactaccgttacgttaggtttttacggaccgtaagggggtaaccctaaggtaccgttaggggaagtaacgttaccgaaaaggggtaaacctgggggttcggggacttcggaccctaaccctaacgttccttacggttcctttacctacctttccccgttacccccgtccctaacttcccgttaggtaacttaaacgttaacttaacgtttcggttccgttacgggtaacggggtcccggggtcgttcgggggtaccgaaacgggggtccgaaccgtaagg

SEQ ID NO: 435047 - DNA, 500 bp, Homo sapiens
  misc_feature: GZ8MTXP01CW9YO.44.75.G09.1.454.CMB.2.raw
  modified_base (185)..(185): a, c, t, g, unknown or other
  modified_base (342)..(342): a, c, t, g, unknown or other
  modified_base (348)..(348): a, c, t, g, unknown or other
  modified_base (382)..(382): a, c, t, g, unknown or other
  modified_base (413)..(413): a, c, t, g, unknown or other
  modified_base (429)..(429): a, c, t, g, unknown or other
  modified_base (451)..(451): a, c, t, g, unknown or other
  modified_base (481)..(481): a, c, t, g, unknown or other
  modified_base (488)..(488): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccganattaggactttttggcctggttcagcaggagcctggacaaagcccctaagtccctgtattcttttctggatccactttgaagagtgagcccagccaggtcagcgcagtggtctgggacactatttcactctcaccatcagcagcctgccagctgganatttcncgtaacttatactgaccaaataatattcttttancgtacagtttgccagggacaagctgagatanaaagaactgggtggcnacacatctctctctctcctccnctaactcttatattatatacttgttgttgngcggcgngcgacgcgcgaa

SEQ ID NO: 435048 - DNA, 594 bp, Homo sapiens
  misc_feature: GZ8MTXP01B69XY.44.75.G09.1.454.CMB.2.raw
  modified_base (310)..(310): a, c, t, g, unknown or other
  modified_base (330)..(330): a, c, t, g, unknown or other
  modified_base (589)..(589): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgtattctttctggactccactttagaagagtggacgtcccagccaggttcaggcggcagtggttcngggactactatttcactccncaccagtcagcagcctgccagctggactattcgcgtaacttattacctgacctaataatttacttacttttttactaccgttacgttagttttcggaccgtaacggggacctaaggctagggagtaagtaaccgtaaaggtaacctggggtcggcgtgaccactatcgttcgttcttctacttcccttacccgcctaactcttagtaattagttaatacttcgttcgttggaacggcgggcgtcgggacgacggtccgngtaag

SEQ ID NO: 435049 - DNA, 684 bp, Homo sapiens
  misc_feature: GZ8MTXP01AELJH.44.75.G09.1.454.CMB.2.raw
  modified_base (257)..(257): a, c, t, g, unknown or other
  modified_base (273)..(273): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtattcttttcnggatccactttgaagngtggacgtcccaggccaggttcacggcggctaggttggttcgtggggactacgtactttcactctacacctatccgagccagcctcgccacgcgtggacgtactttaccgacgttaactttacttaccgtacgaccctaaataattacttttaccttttttaacgtacccgtttaacgttacggttttcgggaccggtaacgggggtaacctaaggtccgttagggaacgaagtaaccgaaaagggtaacgttacggggtcgggactcggaccctaaccgtacgttccttacggttcccttactaccttcccttccccggcctaactcttacgtaattaacgtaacgttaccgttccgttgggacgggtccggggtcgtaacgggaccggtacgggccgaacgttaagtcg

SEQ ID NO: 435050 - DNA, 586 bp, Homo sapiens
  misc_feature: GZ8MTXP01CGKLN.44.75.G09.1.454.CMB.2.raw
  modified_base (251)..(251): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggtctgggacacatttcacttctcaccatcagcagcctgccagctggagtatttccgcgtaacttattactcgaccaactaattacttacttttttactccgttacgttagttttgggtacgtacgggggtacctaaaggtccgtagggagagttaaccgaaaggtaaccgtggggtaggtcgtacgaccacctagttccttgttccttctacttcccttcccgcctaactcttagtacttagttactacttgttcttggtaacggcgggtcgtcggacgaggtcgcaag

SEQ ID NO: 435051 - DNA, 617 bp, Homo sapiens
  misc_feature: GZ8MTXP01DM288.44.75.G09.1.454.CMB.2.raw
  modified_base (252)..(252): a, c, t, g, unknown or other
  modified_base (267)..(267): a, c, t, g, unknown or other
  modified_base (296)..(296): a, c, t, g, unknown or other
  modified_base (339)..(339): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaagcccctaagtccctgatctttcnggatccatttgaagngtggagcccagccagtcagcgcagtgtcnggacacatttcactctcaccatcagcagcctgccagctggatnttcgctaacttatactcgaccaaactaattattctttttactccgttaactaggttttcggaccgtacggggtaacccgtaaagcgtaggaacgtaataaccgtaaaaggaacgttggggttcggacgttcgaccacctaacttccttggttccctttactaactttcccctttaccccggcccctaattccgttagtaacttaagttaaacttaaccgttgttccgttagggaacggccggggttcggtacgggccgaaaggggtcccgaacgtaag

SEQ ID NO: 435052 - DNA, 674 bp, Homo sapiens
  misc_feature: GZ8MTXP01CST8N.44.75.G09.1.454.CMB.2.raw
  modified_base (303)..(303): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaagcccctaagtccctgattctttctggatccactttgaagagtggagtcccagccaggttcagcggcagtggtcngggacacatttcactctcaccatcagcagcctgcccagctggagtatttccgcgtaacttattactcgaccaaactaattatttcttttttacttcccgttaacttaggttttcggaccgtaacgggggacctaacggtccgtagggtaacgaagttaccgaaaagggtaaccgttgggggttacggggcttacgggacctaacccgtaacttccgttcggtttacctttaccctaactttcccccgtttcccccggtacccttaacgtttcccttggttaaaccttaaagtttaaacttaccgtttacggtttcccgttagggaacgggtccggggtcgttacggggtacgaaacggggtcgaacgtaag

SEQ ID NO: 435053 - DNA, 594 bp, Homo sapiens
  misc_feature: GZ8MTXP01DBIPP.44.75.G09.1.454.CMB.2.raw
  modified_base (332)..(332): a, c, t, g, unknown or other
  modified_base (441)..(441): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggccttggtttcagcaggagcctggacaaacgcccctaagtccctgattctttctggatcctactttgaagagtgacgtcccagccaggtcagcggcagtggtctggacactatttcactctcaccatcancagcctgcccagcgtggagtacttccgacgtaacttatactcgaccctaaataattatttactttttactcgttactagtttcggaccgtaggggaccaagctaggganagtacgaaaggtaactggggtaggtctacgacctactactctgttaccttctactcccttcccgctaacgttcttagtaattacgtaacttacgttcgttcgttcggaacggtcccggggtgttacggggaccgttaagggtcccgaagtaag

SEQ ID NO: 435054 - DNA, 708 bp, Homo sapiens
  misc_feature: GZ8MTXP01A7EYF.44.75.G09.1.454.CMB.2.raw
  modified_base (252)..(252): a, c, t, g, unknown or other
  modified_base (707)..(707): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttcnggatccactttgaagagtggacgtcccagccaggttcagcggcaggtgttctgggacactatttcactctcaccatcagcagctgccagcctggagtactttcgacgtcttacgttactcgaccctaaactaattactttcttttttaacgtccgtttaacttacgggtttttcggacccggtaagggggtaacccctaaaggtaccgttaggggaagtaacgttaaccgaaaaacggggtaacccgttggggtacgggggtacctttacgggacccgtaacccgtaacttccgtttcggtttacccgtttaccgttaaccgtttaccccctttccccggtaaccccctaatttacccgttacggttaacttagttaaaccggttcttaacggggttcggacccgggggtcgttcggggtaacgtaaaccggggcccgggttaacgtaacgttgng

SEQ ID NO: 435055 - DNA, 682 bp, Homo sapiens
  misc_feature: GZ8MTXP01BSM48.44.75.G09.1.454.CMB.2.raw
  modified_base (278)..(278): a, c, t, g, unknown or other
  modified_base (306)..(306): a, c, t, g, unknown or other
tcagacagtatatacacgaccggtgctcgatttagtatagacatcaggggtctgcttcagctgtgagcgcagaaggcaggactcgggacaatcttcatcatgacctgcctcccctctcctcctcacccttctcattcactgcgcagggtcctgggcccagtctgcattgacgcacgccgccctcagtgtctgcggccccaggacagagcgtcgccatctcctgctctaggaaacactccaacattggtctaatcatgttacatagtaaccaaaagtcnctgctcgaccctaaagtcctacatttangaatatcttagacgccactcgatctctcgaccgtaattctctgtccctacgttaacgtcctacggtaaactttcacgttccctaactttggccctaagttaccgaacccggtaacttcccgaagacgtacggaacggtaacgaacgggtaccgtaaatttacgttaagtttgggtttcgggtccgtttacggggtacttaccccgtaagtcccggtttggggttcgggtttcgggggttttccggggacggggttaacggggtaccccgttaacggttacggtaaccccggtttaccgttaaacggttcccgtaaaccgggaccccttaaagggccccgttaccggttcccccccgtcggggtttccctaaccccg

SEQ ID NO: 435056 - DNA, 626 bp, Homo sapiens
  misc_feature: GZ8MTXP01DA4PW.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgacttctttctggactcctactttggaagaggtggacgtcccagcctaggtcaggcggctaggtggttcgtgggacactactttcactctcaccatcagcagcctgcccagcctggatctttccgcgtaacttattactcgacctaaactaatttactttctttttactccgttaacgttaggtttcgggaccgtaagggggaacctacggacgtagggaagtataacgtaaaggtacgtaggggtacggtcgtacgacctacctacgtcttcgttcttcctacttccttcccgcctaactcttacgtattacgttacttcgttacgttcgttcggtaacggggtccgggtcgttcgggacggttaacgggtccgcgtaag

SEQ ID NO: 435057 - DNA, 524 bp, Homo sapiens
  misc_feature: GZ8MTXP01D7CG4.44.75.G09.1.454.CMB.2.raw
  modified_base (250)..(250): a, c, t, g, unknown or other
  modified_base (470)..(470): a, c, t, g, unknown or other
  modified_base (490)..(490): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtccccagccaggttcagcggcagtggttctgggacacatttcactctcaccatcagcagcctgccagcctggatatttccgcgtaactttattacctgacccaaactaattatttcttttttactccgttactagttttggccagggggaccaagctggagatcaaaggactgggtaggctgcaccatctgtcttctntctcccgcaatcttgacttntatacttgttcttgaagcgggctggcagcgcaag

SEQ ID NO: 435058 - DNA, 652 bp, Homo sapiens
  misc_feature: GZ8MTXP01AQLMD.44.75.G09.1.454.CMB.2.raw
  modified_base (252)..(252): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcagagcccctaagtccctgattcttttcnggatccactttgaagagtggagtcccagccaggttcagcggcagtggttctgggacacatttcactctcaccatcagcagcctgcagcctggataatttcgcgtaactttatactgacctaaactaattacttacttttttactccgttactaggttttcggcccgtaagggggtacccaaaggtccgtagggaacgtaataacgaaaagggtaaccggttggtacgggtctcggaccaacccctagttccttcggttacctttccgtaaccttcccgtttcccccggccctaactttacccgtacggttaacttaaattaacgttaacctttcgggttaccttgggtaacgggccgggggtaccggttcggggaccggtaaaacggggccgggtaaccg

SEQ ID NO: 435059 - DNA, 609 bp, Homo sapiens
  misc_feature: GZ8MTXP01A73E3.44.75.G09.1.454.CMB.2.raw
  modified_base (252)..(252): a, c, t, g, unknown or other
  modified_base (516)..(516): a, c, t, g, unknown or other
  modified_base (603)..(603): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatcttttcnggtatccactttgaagagtggagtcccagcaggtcagcggcagtggtctgggacacatttcactctcaccatcagcagcctgccagcctggagtactttcgcgtaacttattactgaccctaataattactttctttttactccgttactaggttttcggaccgtagggggtacccaaggtctggaagaagtaccaaaagggtactaggggttcggacttcgacctacctacttcgtgttccttctaaccttcccgttaccccnctaacttcccgttataattacttaacttaacgttcggttccgttcgggaagggtccggggtccggttcgggaccgttaaaggggtcncgtaag

SEQ ID NO: 435060 - DNA, 662 bp, Homo sapiens
  misc_feature: GZ8MTXP01AXHLC.44.75.G09.1.454.CMB.2.raw
  modified_base (254)..(254): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgtattctttcnggatccactttgaagagtggagtcccagccaggttcaggcggctaggttggttcgtggggactactactttcactctcaccatcagcagcctgccagctaggatactttcgcgtaactttattactacgacctaaataatttactttactttttactccgttacgttaggtttcgggaccgtacgggggtaacctaaggtcgttagggaagtacgtaacgaaaacgggtaaccgttgggggtacgggtaccgttacgacctaaccgtactttccgttcgtttcctttctacctttcccgttccccgccttaacttccgttagttaacttaacttaacgttaacgttcggttccgttaggggaacgggtccggggccgttagggaccggaacggggccgttaacgtaag

SEQ ID NO: 435061 - DNA, 521 bp, Homo sapiens
  misc_feature: GZ8MTXP01A7ZCK.44.75.G09.1.454.CMB.2.raw
  modified_base (251)..(251): a, c, t, g, unknown or other
  modified_base (348)..(348): a, c, t, g, unknown or other
  modified_base (516)..(516): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagcccaggttcagcggcagtggttctgggacacatttcactctcacccatcagcagcctgccagcctgganatttccgcgtcttagttactgcccaaactaattattcttttttatccgttactagttttggccaggggaccaagctggagatcaaagactggtggctgcaccatctgtcttcatccttcccgccaatcttgacttatatacttgttcttgaagcgggctggcagggcncgaag

SEQ ID NO: 435062 - DNA, 751 bp, Homo sapiens
  misc_feature: GZ8MTXP01D9LG8.44.75.G09.1.454.CMB.2.raw
  modified_base (322)..(322): a, c, t, g, unknown or other
  modified_base (342)..(342): a, c, t, g, unknown or other
  modified_base (711)..(711): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttgggccttggtttcagcgaggacgccagggaccaaacgtccccctaagtccctgtacttcttttctggacttcccaatttggaagagtggacgtcccagccaggttcagcggcagtggttcnggacatatttcactctcacntcagcacgcctgcccacggcctagggtatacgttttaccgacgttaactttattacctcgtaaccctaaactaatttacttttacttttttaaacgtccgttaacgttaggtttacgggaccggtaaacgggggtaaccctaaagggtccgttaggggaacgtaacgtaaaccggtaaaaagggtacgttagggggttaacggggtccgttacggaacccctaaacccgtacgttaccctttcggtttaaccctttccgtaaccgtttcccctttaccccccggaccttaaacggttcccttaaggttaaacctttaagtttaaacttaacccgttggtttcccgttaagggccgggtcccgggggttnttaccgggggacgttaaacggggtccggttaaccgtaagg

SEQ ID NO: 435063 - DNA, 523 bp, Homo sapiens
  misc_feature: GZ8MTXP01CKVI9.44.75.G09.1.454.CMB.2.raw
  modified_base (250)..(250): a, c, t, g, unknown or other
  modified_base (343)..(343): a, c, t, g, unknown or other
  modified_base (363)..(363): a, c, t, g, unknown or other
  modified_base (520)..(520): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagcccagccaggttcagcggcagtggttctgggacacatttcactctcaccatcagcagcctgccagctgganatttcgcgtaacttattacngacccaactaattattctttttatccgttactagttttcggccaggggaccaagctaggagatacgaaaggactggggtggctgccacctatctgtcttctacttccttcccgccaatcttgattatatacttgttcttgaagcggctggcaggcgngaa

SEQ ID NO: 435064 - DNA, 675 bp, Homo sapiens
  misc_feature: GZ8MTXP01CX2V6.44.75.G09.1.454.CMB.2.raw
  modified_base (316)..(316): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgtattcttttctggtactcctactttggaagtaggtggacgtccccagcccaggttcagcggcagtggttcngggacacatttcactctcacatcagcagcctgccagcctggatatttcgcgtaactttattactacgacctaaactaattactttccttttttacttaccgttacttaggttttcggaccgtaacggggtaccctaaagtccgttagggaagagttaacgaaaacggtaaccgttaggggtacgggtacttcggaccgtaacctaacttccgttacgtttcccttccgttaaccgttccccgttcccccgtccctaacttacccttaggttaaaccttagttaaacgttaacttcgggttccgttagggaacggggtccgggtcggttcggggaccggttaagggtcccgttcgtaagg

SEQ ID NO: 435065 - DNA, 616 bp, Homo sapiens
  misc_feature: GZ8MTXP01B7BOP.44.75.G09.1.454.CMB.2.raw
  modified_base (341)..(341): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgattctttctggatccactttgaagagtggagcccagccaggtcagcggcagtgtctgggacacatttcactctcaccatcagcagctgccagctgganattcgcgtaactttattactcgacctaactaattatttactttttactccgttactagtttcggaccgtaaggggaacccaagtcgtaggaagacgtaacgaaacggtaacgttaggggttaggtccgttacggacctaacctacttcgttcggtttcccttctaccttccctttccccgacctaacttccttaggttaacttatttaacttaacttcgttccgttaggtaacgggtcgggtcgttcgggacgttaacgggccgttaacggtaag

SEQ ID NO: 435066 - DNA, 727 bp, Homo sapiens
  misc_feature: GZ8MTXP01DCSES.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttgggtttcagcaggacgcctggacaaacgcccctaagtccctgtattctttcgtggacttccactttggaagtaggtggagtccccagccctaggttcaggcggcgtagtggttctggacactatttcactctcaccatcagcagctgccagctggagtatttccgacgtctttaattacctctaaccctaaactaaattacttttaccttttttaacttaccgttaacgttaaggtttttcgggacccgttaaaggggggaaccctaaggtaccgttagggaagaaacgttaacgaaaaaacggggtaaccttgggggttacgggacttacgggaaccctaacccgtaagttccgttacgtttcctttaaccgtaccgtttccccgtttacccccgaccccttaaatttccgttacgttaaacttaagttttaaacgtttacccttagggttcccgtttaggggtaacgggtcccgggggtcgggtacgggtacggttaacgggtaaccggttaacgtaacg

SEQ ID NO: 435067 - DNA, 517 bp, Homo sapiens
  misc_feature: GZ8MTXP01DDDWT.44.75.G09.1.454.CMB.2.raw
  modified_base (420)..(420): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaacgcccctaagtccctgattcttttctggatccactttgaagagtggagtccccagccaggttcagcggcagtggtctgggacacatttcactctcacccatcagcagcctgccagctggagatttcgcgtcttattactgaccaacaattacttctttttactcgttactagtttggcagggacagctgganatacaaagactgggtgctgacaccatctgtcttctacttcctcccgctaatcttgattattatacttgttcttgaagcgggctggcgaggcgcgtaa

SEQ ID NO: 435068 - DNA, 520 bp, Homo sapiens
  misc_feature: GZ8MTXP01A72IA.44.75.G09.1.454.CMB.2.raw
  modified_base (252)..(252): a, c, t, g, unknown or other
  modified_base (474)..(474): a, c, t, g, unknown or other
  modified_base (520)..(520): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagccccctaagtccctgatcttttcnggatccactttgaagagtggagtcccagccaggttcagcggcagtggttctggggacacatttcactctcaccatcagcagcctgccagcctggagattttcgcgtaactttattactgccaactaattattcttttttatccgttactagttttggccaggggacccagctggagatacaaaggaactgggtggctgcaccatctgtcttcattcctcccncaatcttgattatatacttgttcttgaagcggctggcaggccgaan

SEQ ID NO: 435069 - DNA, 682 bp, Homo sapiens
  misc_feature: GZ8MTXP01CTPPL.44.75.G09.1.454.CMB.2.raw
  modified_base (306)..(306): a, c, t, g, unknown or other
  modified_base (311)..(311): a, c, t, g, unknown or other
  modified_base (313)..(313): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgtattctttctggactccacgtttgaagagtggagtccccagccaggttcagcgcagtgtcnggacncntttcactctcacatcagcagcctgcccagctggagtactttcgcgtaacttattactacgacctaaactaattacgtttcttttttacttaccgttaacgttaggttttcgggacccgtaacgggggtaaccctaaagggtacttacggggaaagtaacgtaaaccgtaaaaggggtaaccgttagggggttacggtacgttacggaccctaaccgtacttccgttcgtttaccctttcctaaccgtttccccttcccccgccttaactttcccgttacggttaacttaagttaactttaacccgttggttccgttacgggaacgggtccggggtccgttggggaccgaaacggggtccaaccggtaag

SEQ ID NO: 435070 - DNA, 695 bp, Homo sapiens
  misc_feature: GZ8MTXP01AP8E2.44.75.G09.1.454.CMB.2.raw
  modified_base (257)..(257): a, c, t, g, unknown or other
  modified_base (310)..(310): a, c, t, g, unknown or other
  modified_base (354)..(354): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgtattcttttacnggtactcctactttgaagagtggagtcccagccaggtcagcggcagtggttcngggacactatttcactctcacatcagcagctgccagctggactntttaccggactaacttatactgacctaaactattactttactttttataccgttagttacgtttacggaccgtaagggggtaaccaaacggtcgtagggaagacgttaaccgaaaagggtaagtccccgggggttagggaccttacgggaccctaacccgttaacgttcctttacggtttacccttttcctaaaccgttttccccgttacccccgtcccttaacgtttcccgttaagttaatttaaacgttaactttaaccgtttcggttccggtttagggtaacggggtcccggggaacggttacggggacggttaaaccggggtcccgttaaacgtaag

SEQ ID NO: 435071 - DNA, 742 bp, Homo sapiens
  misc_feature: GZ8MTXP01AN7HE.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtacttcttttctggactcctactttagaagagtggagtccccagcctaggttcaggcggctagtggttctggggactacgtatttcactctcaccatcagcagccctagcccacgcctaggacgtatttcgaccgtaactttacttactacgaccctaaactaatttacttttacctttttttaactcccgttaactttacgggtttttacgggacccggtaacggggtaacccgtaaaggtccgtagggtaaacgtaacgtaaaccggaaaaggggtaaccgttaaggggggtcggtaccgttacggaccctaaaccgtacgtttaccttcggttaccctttacgtaaccctttccccgtttcccccggtacccttaaccgttaaccgttacgttaaatttaaaccgttagtttaaaccttcggtttcgttaaacgggtccggggaccggggtcgttaccggggacggttaaaccgggtccgggttaacctaagg

SEQ ID NO: 435072 - DNA, 670 bp, Homo sapiens
  misc_feature: GZ8MTXP01ASKMA.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgattctttctggacttccactttgaagagtggacgtcccagccaggttcaggcggctaggtggttctgggactactatttcactctcaccatcagcagcctgcccgagctggaagtctttccgacgtcttattaccgtgaccctaaactaattactttacttttttactccgttactacggttttcggaccgtacgggggtaaccaaggtcgtagggaacgtacgtaacgaaaacggtaacgtcggggtacggtcgttacggacctaacctacttccgttcgttccttttcctaacctttcccttcccccgtaccctaacttcccttaggtaaaccttaagtttaaacttaacccgttgggttcccgttagggaacggggtcccggggtaacggttcggggaccgttaacggggccgttaacgtaagg

SEQ ID NO: 435073 - DNA, 645 bp, Homo sapiens
  misc_feature: GZ8MTXP01A9FIB.44.75.G09.1.454.CMB.2.raw
  modified_base (268)..(268): a, c, t, g, unknown or other
  modified_base (303)..(303): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttctggatccactttgaagngtggactcccagccaggttcagcggcagtggttcngggacactatttcactctcacccatcagcagcctgcccaggccgtaggagtactttcgcgtaactttacttaactcgacctaaactaattactttactttttactccgttactacggttttcgggacccgtaaggggaaccctaaggccgtagggaagtaacgtacgaaaagggtaaccgtggggtaggtaccgtcggacctaaccgtacgttccttacggttccttcctaccttcccttccccgcctaacttcgttagtattacgttaattaccgttacggttcgttcgggaacgggtccggggtaacgtccgggacggaaacgggtccgttaacggtaag

SEQ ID NO: 435074 - DNA, 517 bp, Homo sapiens
  misc_feature: GZ8MTXP01ANVOV.44.75.G09.1.454.CMB.2.raw
  modified_base (251)..(251): a, c, t, g, unknown or other
  modified_base (452)..(452): a, c, t, g, unknown or other
  modified_base (478)..(478): a, c, t, g, unknown or other
  modified_base (503)..(503): a, c, t, g, unknown or other
  modified_base (517)..(517): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggtctggtttcagcaggagcctggcaaagcccctaagtccctgatcttttcnggatccactttgaagagtggagtcccagccaggttcagcggcagtggtctgggacacatttcactctcaccatcagcagcctgccagctggactatttcgcgtaacttatactgaccaactatatttctttttatccgttactagttttcggcctaggggaccaagctaggagatacaaagactgggtgctgcaccatctntcttcacttccttcccgctaatcttnattatatacttgttcttgaagcggntggcaaggcgaagn

SEQ ID NO: 435075 - DNA, 567 bp, Homo sapiens
  misc_feature: GZ8MTXP01A6A95.44.75.G09.1.454.CMB.2.raw
  modified_base (254)..(254): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgattctttcnggatccactttgaagagtggacgcccagccaggtcagcggcaggttggtctgggacactatttcactctcaccatcagcagcctgccacgcgtggagtctttcgacgtaacttatactcgacctaaataattactttctttttactcgtacttagtttcggaccgagggaaccagctaggacgatacgaaagtactggggacggctgcactactctcgtcttctaccttccttccccgctaactcttagtaattacttaacttacgttcgttcttggaacgggcgggtcgtggacgacgggtccgaacgtaag

SEQ ID NO: 435076 - DNA, 643 bp, Homo sapiens
  misc_feature: GZ8MTXP01BWDYC.44.75.G09.1.454.CMB.2.raw
  modified_base (254)..(254): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttcnggatccactttgaagagtggagtccccagccaggttcagcggcagtggtctgggacacatttcactctcaccatcagcagcctgccaggcctggagtatttcgcgtaacttattacctgaccctaaactaattatttcttttttatcccgttacgttaggttttcggacccgtagggggtaaccctaaggtccgtagggaagataaccgaaaagggtaaccgttggggtacgggtccgttcggacctaacctaacttccgttcggttcctttcctacttccctttccccgcctaacttccttacggtaattacgttaacttaacctttcggttccgttgggaacgggtccgggggtcgttcggggacgaaacgggtcccggaacgtaag

SEQ ID NO: 435077 - DNA, 589 bp, Homo sapiens
  misc_feature: GZ8MTXP01CNAQA.44.75.G09.1.454.CMB.2.raw
  modified_base (251)..(251): a, c, t, g, unknown or other
  modified_base (307)..(307): a, c, t, g, unknown or other
  modified_base (518)..(518): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgatctttcnggatccatttgaagagtggagcccagccaggttcagcggcagtggtctgggacacntttcactctcaccatcagcagcctgccagctggacgtatttccgcgtaacttattactagacccctaaataattactttctttttactccgttactaggttttcggaccgtaagggggtaaccaaggtctagggaagacgtaacgaaaagggtaacgtgggtcggtctacggacctacctaattcctgttccttactaccttccttccccnctaactccttggtattagtaacttacttgttcttggtaacggtccgggtgtgggacgacgggtcgcgtaag

SEQ ID NO: 435078 - DNA, 557 bp, Homo sapiens
  misc_feature: GZ8MTXP01EFYOL.44.75.G09.1.454.CMB.2.raw
  modified_base (256)..(256): a, c, t, g, unknown or other
  modified_base (273)..(273): a, c, t, g, unknown or other
  modified_base (310)..(310): a, c, t, g, unknown or other
  modified_base (316)..(316): a, c, t, g, unknown or other
  modified_base (331)..(331): a, c, t, g, unknown or other
  modified_base (389)..(389): a, c, t, g, unknown or other
  modified_base (469)..(469): a, c, t, g, unknown or other
  modified_base (515)..(515): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtcgccgactattaggtacttttttggccttggttcagcaggagcctggcaaacgcccctaagtccctgattcttttnggattccactttgaagngtcggatccccagtccaggttcagcggcagtggttcngggacnatttcactctcaccntcagcagcctgcccagctggatactttcgcgtaactttatactgacccaattaacttnttactttttatccgttactgtttacggaccgagggaccagcgtagagatacgaaagactgggtgactgacactatcgttntacttctactccttccgctaatcttagtacttatattacttgttcnggtaacgggccgggtcgacgggtacgaaggggtccaagtaag

SEQ ID NO: 435079 - DNA, 705 bp, Homo sapiens
  misc_feature: GZ8MTXP01BDZFX.44.75.G09.1.454.CMB.2.raw
  modified_base (251)..(251): a, c, t, g, unknown or other
  modified_base (309)..(309): a, c, t, g, unknown or other
  modified_base (328)..(328): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggacgtcccagccaggtcagcggcagtggttctgggacanatttcactctcaccatcancagcctgcccaggctggatactttcgacgtcttacttactcgacctaaactaattactttacttttttagtaccgttaacttacggttttacggacccgtaacgggggaacccgtaaagtccgttagggaagtaaacgttaacgaaaaacggggttaaccgttagggggtttcggggaccctttaggaccccgttaaacccgtaacgtttcctttcggtttacccttttaccgtaaccgtttaccccgtttcccccgtccctaactttacccgttacgtaaatttaacgtttaacgttaaccctttggtttccttacgggttaaggggcccgggggttaacgttcgggggacgttaaacggggtcccgaacgtaagg

SEQ ID NO: 435080 - DNA, 700 bp, Homo sapiens
  misc_feature: GZ8MTXP01A2559.44.75.G09.1.454.CMB.2.raw
  modified_base (256)..(256): a, c, t, g, unknown or other
  modified_base (357)..(357): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgacttcttttcnggactccactttgaagagtggacgtcccagccaggttcagcggcagtggtctgggacacatttcactctcacatcagcacgcctgcccagccgtggacgtntttaccgcgttaacttacttactacgaccctaaactaatttactttctttttatacccgttactacggttttacggaccgtaacgggggtaaccctaaggtaccgttagggaacgtaacgttaacggaaaacggtaaccgttcgggggtagggtaccgttacggaccctaacccgtacgtttaccttacggtttcccttaccgttaaccgtttcccctttcccccggtacccttaacgttccctttacggtaaatttacgttaacttaaccgttggttacccgttagggtaacgggttccgggggaaccgttggggtacccggaaggggtcccgaacggtaag

SEQ ID NO: 435081 - DNA, 539 bp, Homo sapiens
  misc_feature: GZ8MTXP01BOYF2.44.75.G09.1.454.CMB.2.raw
  modified_base (257)..(257): a, c, t, g, unknown or other
  modified_base (315)..(315): a, c, t, g, unknown or other
  modified_base (341)..(341): a, c, t, g, unknown or other
  modified_base (349)..(349): a, c, t, g, unknown or other
  modified_base (380)..(380): a, c, t, g, unknown or other
  modified_base (457)..(457): a, c, t, g, unknown or other
  modified_base (534)..(534): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggccttggtttcagcaggagcctggacaaacgcccctaagtccctgattcttttcnggatccatttgaagagtggacgtcccagccaggtcagcggcagtggtctgggacactntttcactctcacatcagcagctgccngctggatntttcgctaacttatactgacctaaataattntttactttttactccgtattagtttcggacgaggggtaccagcgtaggagatacgaaagctaggggtcgctcgcacntctgtcttctactcctcccgctaactcgattattatactgttacgttgacggtcgggtcgtggacgacgggcaacgngtaag

SEQ ID NO: 435082 - DNA, 524 bp, Homo sapiens
  misc_feature: GZ8MTXP01BF3OX.44.75.G09.1.454.CMB.2.raw
  modified_base (252)..(252): a, c, t, g, unknown or other
  modified_base (268)..(268): a, c, t, g, unknown or other
  modified_base (519)..(519): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattctttcnggatccactttgaagngtggagtcccagccaggttcagcggcagtggttctgggacactatttcactctcaccatcagcagcctgcccagcctggatatttcgcgtaacttatactcgaccaaatattatttctttttatccgttatagtttggcagggaccagctaggagatacaaagtaactgggtgctgcacgatctgtcttctactccttcccgctaatcttgtattatactacttgttcttgaagcgggctggacacggcgngtaag

SEQ ID NO: 435083 - DNA, 645 bp, Homo sapiens
  misc_feature: GZ8MTXP01C6NWD.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggccttggtttcagcaggagcctggacaaacgcccctaagtccctgtacttctttcgtggactccactttgaagaggtggagtcccagcaggtcagcggcagttggtctgggacactatttcactctcacctatcgagcagcctgcacgccgtggacgtatttccggctaacttattacgcgacctaactaattctttactttttacttccgttaacttagggtttcggacccgtaagggggaaccctaggtcgttagggaacgtaactaaccgaaaagggtaccgttagggggtacggtcgttcgaccgtaacctacgttccttcgtttaccttactaccgtttccctccccggtcctaacgttccttaggttaacttagttacttaacgttcgttccgttaggtcggtcggggtccgtgggacgaacggggtccgaataagg

SEQ ID NO: 435084 - DNA, 660 bp, Homo sapiens
  misc_feature: GZ8MTXP01AKECR.44.75.G09.1.454.CMB.2.raw
  modified_base (257)..(257): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggcctggtttcagcaggagcctggacaaacgcccctaagtccctgtattcttttcnggattccactttggaagtagtggacgtcccagcctaggtcaggcggcgtaggtggttcgtgggacactatttcactctcacatcagcagctgccagcgtggatacgtttaccgcgtaactttaatacctagaaccctaaataactttacttttacttttttaaccgttccgttaacgttacggttttcgggaccggtaacggggtaacctaaaggtccgtagggaacgtaacgtaacgtaaaagggtaacgtggggttacggcgtcgacctacctacgttcttacgttccttctacctttcccttcccgtacctaacttaccgttagtacttaacttacttacgttcggttcgttacgggtaacgggtcgggtcgtcgggacgaacgggcgttaaccggtaag

SEQ ID NO: 435085 - DNA, 785 bp, Homo sapiens
  misc_feature: GZ8MTXP01DXYIK.44.75.G09.1.454.CMB.2.raw
  modified_base (256)..(256): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggcctggtttcagcaggagcctggacaaacgcccctaagtccctgtattctttcnggacttcctacgtttgaagtaggtggacgtcccagccaggttcaggcggcaggtggttctggggactactactttcacttctcaccctatcagcagcctggccacgtccgtggacgtactttccgacgttaactttattacctacgtaacccaaactaactttactttttacttttttaacttacccgtttaacgttacgggttttacggaccggttaaacggggggtaaaccctaaagggtccgttaggggaacgtaacgttaaaccggaaaaagggttaaaccccgtttggggggttaacggggtcctttaacgggacccgtaaaccccgtttacgtttccgtttaccgtttacctttaccgttacccgttttacccccgtttacccccgtaaccttaaccgtttaccgttaacgtttaaactttaaacgtttaaccgtttaccgtttcgggttccggttacggggtaaccggggttaccgggggttccggttacggggaccggttaacgggtcccgttaacgtaag

SEQ ID NO: 435086 - DNA, 769 bp, Homo sapiens
  misc_feature: GZ8MTXP01DQRJJ.44.75.G09.1.454.CMB.2.raw
  modified_base (333)..(333): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgattctttctggacttccactttgaagagtggagtcccagccaggttcagcggcaggtggtctggggacacatttcactctcacccatcancagcctgcccagcctggagtactttccgcgtaacctttataccgttacgacccctaaactaacgtttaattttacctttttttaacgtacccgtttaacgttacggtttttacgggacccgttaaacgggggaaccccgtaaaggtccgtttacggggtaaagaacgttaaccgtaaaagggtaaaccccgtttgggggttacggggtactttacgggtacccgaaacccgtaaccgtttcccttgggtttaaccctttccgttaaaaccgtttaccccgtttttcccccccgaacccgttaaaaccgttcccctttaacgggtaaacgttttaaacgttaatttaaacccggtttacggtttcccgttacgggtaagggggacccggggttcccggttggggacccggttaaaagggggtcaacccgggttaaag

SEQ ID NO: 435087 - DNA, 516 bp, Homo sapiens
  misc_feature: GZ8MTXP01ANENY.44.75.G09.1.454.CMB.2.raw
  modified_base (250)..(250): a, c, t, g, unknown or other
  modified_base (467)..(467): a, c, t, g, unknown or other
  modified_base (493)..(493): a, c, t, g, unknown or other
  modified_base (495)..(495): a, c, t, g, unknown or other
  modified_base (503)..(503): a, c, t, g, unknown or other
  modified_base (512)..(512): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtcccagccaggtcagcgcagtggtctgggacacatttcactctcaccatcagcagcctgccagcgtggagatttcgcgtcttatactgacctaacaattattctttttatccgtactagtttcggcgtaggggaccaagctggagatacgaaaggtactgggtacggctgacaccatctgtcttctatcttcccnctaatcttgattatatacttgttcgngnggcggcgnggcgagcgngaag

SEQ ID NO: 435088 - DNA, 588 bp, Homo sapiens
  misc_feature: GZ8MTXP01CJ4Y5.44.75.G09.1.454.CMB.2.raw
  modified_base (273)..(273): a, c, t, g, unknown or other
  modified_base (309)..(309): a, c, t, g, unknown or other
  modified_base (372)..(372): a, c, t, g, unknown or other
  modified_base (516)..(516): a, c, t, g, unknown or other
  modified_base (537)..(537): a, c, t, g, unknown or other
  modified_base (583)..(583): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtattctttctggactccactttgaagngtggacgtcccagccaggtcaggcggcagtggttcngggacacatttcactctcaccatcagcagcctgcccaggccggagtactttcgacgtactttntactcgacctaaactaattactttctttttactacccgttacttaggttttcggaccgtaacgggaccaagtcgtaggacgatacgaaaaggtactaggtcgggcgtacggcacctatcgtattcttactacttccgttccccncctatcctagttattaacttntaactgttccgttgggacgtcggggctcgggcgaacggccgtaagngtaag

SEQ ID NO: 435089 - DNA, 664 bp, Homo sapiens
  misc_feature: GZ8MTXP01DKQUD.44.75.G09.1.454.CMB.2.raw
  modified_base (252)..(252): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggatccactttgaagagtggagtcccagccaggtcagaggcagtggtctgggacacattcactctcacatcagcagcctgccagctggatatttcgacgtaacttatactcgaccaaactaattactttcttttttactccgttactaggttttcggaccgtaagggggaaccctaaaggtcgttagggaagaactaacgaaaagggtaaccgttaggggtacggggtaccttacggacctaaccctaagttccttacggtttacctttacctaactttaccctttcccccggtacctaactttccttaggttaactttaagttaaactttaaccgttggtttcccgtttacgggtaaggggccgggggtaacgttcgggggacggttaaacgggggtccgaaccggtaaag

SEQ ID NO: 435090 - DNA, 550 bp, Homo sapiens
  misc_feature: GZ8MTXP01DHYT7.44.75.G09.1.454.CMB.2.raw
  modified_base (344)..(344): a, c, t, g, unknown or other
  modified_base (523)..(523): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagctggcaaacgcccctaagtccctgattctttctggatccactttgaagagtggacgtcccagccaggtcaggcggcaggtggttcgtgggactactatttcactctcacccatcagcagcctgccngctggagtactttccgcgtaacttattactcgaccaatacttatttctttttatccgttattacgtttcggccgtaaggggaccaaggtctaggagatacgaaagtacgtggggtacggctcgaccactatcttgttcttctacttccttcccgctaatcttgtattatatcttgttcngtaaggcggcgtggcgaggtcgctaag

SEQ ID NO: 435091 - DNA, 560 bp, Homo sapiens
  misc_feature: GZ8MTXP01B0KBY.44.75.G09.1.454.CMB.2.raw
  modified_base (251)..(251): a, c, t, g, unknown or other
  modified_base (266)..(266): a, c, t, g, unknown or other
  modified_base (360)..(360): a, c, t, g, unknown or other
  modified_base (501)..(501): a, c, t, g, unknown or other
  modified_base (552)..(552): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatctttcnggatcactttgaagngtgagtccagccagtcagcggcagtggttctggacacatttcactctcaccatcagcagcctggcccaggccggagtactttcgacgtaacttntactcgaccctaaactaatttacttacttttttactacccgttactaaggttttcggccgtaaggggaccaaagcttaggagacgtacaaaggtactgtcggggctcggacaccattcgttactcttacacttccctcccnctaatctagttatattatactgttcgttgacggtcgggctcggcacgggcncaagtaag

SEQ ID NO: 435092 - DNA, 565 bp, Homo sapiens
  misc_feature: GZ8MTXP01CCJW0.44.75.G09.1.454.CMB.2.raw
  modified_base (251)..(251): a, c, t, g, unknown or other
  modified_base (528)..(528): a, c, t, g, unknown or other
  modified_base (562)..(562): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagccccagccaggttcagcggcagtggttctggggacacatttcactctcaccatcagcagcctgccagctggatatttcgacgtaacttattacctgaccctaactaattacttctttttttactcccgtttaactaggtttttacgggcccgtagggggtaacccaaggtctagggaagatacgaaagggaactaggggtggcttcggaccaccgtatcctgttccttctacttttcccgcctagtctgatattntactgttcttgaggcgggctggcgtaggcgtcgngtg

SEQ ID NO: 435093 - DNA, 658 bp, Homo sapiens
  misc_feature: GZ8MTXP01ECAAE.44.75.G09.1.454.CMB.2.raw
  modified_base (652)..(652): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgtattctttctggacttccactttggaagaggtggacgtcccagcctaggttcaggcggctaggtggttcgtgggacactatttcactcctacaccatcagcagcctgccacgcgtgagtactttcgacgtaactttactactcgacctaaactaactttacttttactttttactacccgttaacgttacggtttcggaccgtagggggtaaccacggtacgtagggaagtaactaacggaaaacggtaacgtggggtacgggtctacgaccgtaactacttctacgttacccttccgtacttccccgttccccgaccttaacttccgttacgtaaatttacgttaaacttaacgttcgttacggttcggtaacgggccgggtcggttacgggacccgaggggtccnggtaag

SEQ ID NO: 435094 - DNA, 538 bp, Homo sapiens
  misc_feature: GZ8MTXP01EQZXG.44.75.G09.1.454.CMB.2.raw
  modified_base (367)..(367): a, c, t, g, unknown or other
  modified_base (376)..(376): a, c, t, g, unknown or other
  modified_base (483)..(483): a, c, t, g, unknown or other
  modified_base (489)..(489): a, c, t, g, unknown or other
  modified_base (524)..(524): a, c, t, g, unknown or other
tcagacagtatatacacgaccggtgctcgatttagtatagacatcagggacttaggggctttgccaggctcctgctgctctgtttccccggtgccagatgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttctggatcctacttgaagagtggatcccagccaggttcagcggcaggtggttctgggacactatttcactctcacatcagcagcctgcagcctggatactttcgcgtactttattacngaacctaanatttatttctttttatccgttactgtttcgacgtagggtactaagctaggagtataacgaaaggtaacgtgtggctcgcaccatctacgtcttccacttccgtcccnctcttntgaattatacttacgttgactggacggcgggtcgnggactaacgcgaag

SEQ ID NO: 435095 - DNA, 693 bp, Homo sapiens
  misc_feature: GZ8MTXP01CW8GC.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagctggacaaacgcccctaagtccctgtattctttctggacttcctactttaggaagtaggtggacgtcccagcctaggttcagcggcgaggtggttcgtgggactactactttcactctcaccatcagccagcctgcccgacggccggagtacttccgacgtaactttaacttactcgaaccctaaactaactttatttacttttttactacccgtttaacgttacggttttacgggaccgtaacggggaaccctaaggtccgtagggtaacgaacgttaaccgaaaggtacgtcggtacggggtctacggtacctacctagttccttcggttccttaccttactttccccttcccccggtacccttacttaacccgttaaggttaactttaacttacgttaaaccgttcgttaccggttgggttacgggtcggggtacgttcggggaacccgagggacccgcgttaaggtaag

SEQ ID NO: 435096 - DNA, 694 bp, Homo sapiens
  misc_feature: GZ8MTXP01D2AUY.44.75.G09.1.454.CMB.2.raw
  modified_base (228)..(228): a, c, t, g, unknown or other
  modified_base (691)..(691): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcgaggtcgttttcggtgcttgttgcctggtttacaaacgaaaagggggngacggcccctaaggtcctcgtctctcgtagaaaccagacgtggaaggtagacgtcccgtccaggttcagtgccagtccgagggtggtgggccggagtcccactctcaccattagcgacctggcggcctgaagattctagcctaactttatttctgttccaagtccaaggttactcgaagttacggtccgtcccccgtttataccgtttttcgggaccgtaacggggaccaaggtacgtacgggtaaaactaaccgaaaacgtaaccgtggttacggcgtacgacctaaccgtaatttccgtttcgttacctttacctaaccgtttccctttacccccggtaccttaacttcccggttagttaacttaacgtttaacttaacgttcggtttcgttacggggtaaccgggtccgggggttccggttcggggaccgtaaacgggcccgaacgttaaggtagagtgngtg

SEQ ID NO: 435097 - DNA, 676 bp, Homo sapiens
  misc_feature: GZ8MTXP01AX1T6.44.75.G09.1.454.CMB.2.raw
  modified_base (261)..(261): a, c, t, g, unknown or other
  modified_base (319)..(319): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtcgccgactattaggtactttttttggccttggtttcagcaggagcctggacaaacgcccctaagtccctgtacttctttcnggactcctactttaggaagtgtcggagcccagcctaggttcaggcgctagtcggttcncgggacactatttcactctacaccatcgagcacgcctgcccagtccgtggtactacttttccggacttaactttattaccgacgaacctaaacttaatttacgttttaccttttttacgtaccgttaacgttacggttttacgggaccgaacgggggtaaccctaagcgttagggaacgttaacgtaaccgaaaggtaacgtgggggttacggcttacggaccctaactattccgtttaggttccctttactacgttcccctttccccgacttaaccttcgttacgtaacttaccgttaaattccttaggttccgttagggaacgggtcgggtctcgggacgttacgggcgaataag

SEQ ID NO: 435098 - DNA, 675 bp, Homo sapiens
  misc_feature: GZ8MTXP01CZBHG.44.75.G09.1.454.CMB.2.raw
  modified_base (252)..(252): a, c, t, g, unknown or other
  modified_base (298)..(298): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttcnggactcacttgaagagtgagtccagccaggtcagcgcagtgttcgngggacacgctttcactctacaccatcagcagcctcgccagcctggactacgtttcgacgtaacttacttactcgtaaccaactaacttacttactttttacttaccgttaactaggttttacggaccgtaacggggtaacctacgggacgttaggaagaacgtaaccgtaaagggtaaaccttgggggttaccggtaccgtacggtaccgtaaccgtaaccttccgttaacggtttaccctttccggttaaacctttccccggtttccccgtacccgttaaacgttccgttaccgttacttaaatttaacgttaacgttcgttacgttacgggtaacgtccggggtcgtacgggacgaccggtcggttaacctaagg

SEQ ID NO: 435099 - DNA, 701 bp, Homo sapiens
  misc_feature: GZ8MTXP01EB1XA.44.75.G09.1.454.CMB.2.raw
tcagacagtatatacacgaccggtgctcgatttagtatagacatcaggggtctgcttcagctgtgagcgcagaaggcaggactcgggacaatcttcatcatgacctgcctcccctctcctcctcacccttctcattcactgcgcagggtcctgggcccagtctgcattgacgcagcccgccctcagtgtctgccggccccaggacagagcgtcgccatctcctgctctaggaaacactaccaactattggtactaatcatgttacagtacggtaaaccaaaagtcgcgtcggcctaccggacccctaaagtcctactatttagtagtaagtaacttacgttaacgaccggaccctacgtcggactctcgtacgaccgtaacttcctctctaccttacgtaacgtcgtacggtacttcacgtcctacgtttcggacctacgtcccgacccggtactccgacgtacgtagggaacgaacggacggtaccgggttaatttacgttagtttcgggtgggtaccgttcgggtacctaccggtaggttccggtttggggttcgggggtttcgggggtttccgggcgggggttaaccgggtaccccggttacgtaccgggtaaccccgttaccgttaacggttacccgtaacggaccccggtaacgggtcccgttcccgggttcccccgttcggttccgttaaccccg

SEQ ID NO: 435100 - DNA, 600 bp, Homo sapiens
  misc_feature: GZ8MTXP01EAA8S.44.75.G09.1.454.CMB.2.raw
  modified_base (260)..(260): a, c, t, g, unknown or other
  modified_base (276)..(276): a, c, t, g, unknown or other
  modified_base (319)..(319): a, c, t, g, unknown or other
  modified_base (347)..(347): a, c, t, g, unknown or other
  modified_base (365)..(365): a, c, t, g, unknown or other
  modified_base (395)..(395): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacagttaggtacttttttggccttggtttcagcgaggagcctggacaaacgtcccctaagtccctgtacttctttcnggactccatttgaagngtggacgtccagccaggtcagcggctagtggtctgggacactnttcactctcaccatcagcacgcctgccngctggatacttcgacgtnttactactgtaccaatatagtttcttttancgttacgtagtttcgaccgtagggtaacctagtctaggaacgataacgaaagggtacttaggggtacgtcgtacgtacaaccgttgttccgttacgttccttacgtaccttccctcccgtactaacttacgttagtaacttaacgtacgttcgttgttcgttacgggtaacggtcgggtcgtacgggacgacggtcgaacgtaag

SEQ ID NO: 435101 - DNA, 700 bp, Homo sapiens
  misc_feature: GZ8MTXP01EX2QJ.44.75.G09.1.454.CMB.2.raw
  modified_base (258)..(258): a, c, t, g, unknown or other
  modified_base (320)..(320): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtacttcttttcnggtactcctactttggaagaggtggacgtcccagccctaggttcaggcggctagtggttcgngggactactactttcactctacaccatcagcagcctgccagctggactgtttccgcgtaactttatactacgaccaaactaattacttttactttttactaccgttacttaggtttcggacccgaggggtaacccaagtcgtagggtagacgttaacgaaaaggtaacgtggggtacggtcgttcgacctaacctacgttccgttacgtttccctttactaaccgtttcccccttacccccggtacccttaacccgtttcgttacgtaaattttaaccgttaaaccttttaacgttacgggtttcccgttaggggttaaccggggccgggggttaaccggtacggggtacccggaaagggggtcccgttaacgggtaaag

SEQ ID NO: 435102 - DNA, 561 bp, Homo sapiens
  misc_feature: GZ8MTXP01BV1K0.44.75.G09.1.454.CMB.2.raw
  modified_base (538)..(538): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaacgcccctaagtccctgtatctttctggatccactttggagagtggacgtcccagccaggtcagcggcagtggtctgggacactatttcactctcacccatcagcagcctgccagtctggatatttcgacgtctttattaccgtgacccaaactaattactttcttttttatccgttactacggttttcggaccgacggggtaccaagtcgtaggagatacgaaagggaacttggggtcggctacgcaccgtatcctagtccttcgtacttccctcccgcctaattccttgtattatatcttagttcttgngtcggctgggcagggccttgaag

SEQ ID NO: 435103 - DNA, 679 bp, Homo sapiens
  misc_feature: GZ8MTXP01BD22M.44.75.G09.1.454.CMB.2.raw
  modified_base (219)..(219): a, c, t, g, unknown or other
  modified_base (256)..(256): a, c, t, g, unknown or other
  modified_base (342)..(342): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggancctggcaaacgcccctaagtccctgtacttcttttcnggacttcctactttggaagtagtggacgtccccagcctaggttcagcgacgtagtggttcgtgggactactatttcactctcaccntcagcagcctgccacgtcgtggacgtactttacgacgtaacttattacgtcgacctaaactaattactttactttttacttaccgttaaccgttaggtttcgggaccggtacggggtaaaccgtaaggtcgtagggtaacgtaagtaaccgtaaaagggtaaccgtggggttacggtacgtaccggaccgtaacccgtaacgttccttcggttacctttactacccgtttcccttccccgtaccctaacttcgttacgttaattacgttaactaccgttgttaccggttaggcggggtccgggtcggttcgggtacggaaccgggcggttaactaag

SEQ ID NO: 435104 - DNA, 695 bp, Homo sapiens
  misc_feature: GZ8MTXP01CCVZT.44.75.G09.1.454.CMB.2.raw
  modified_base (254)..(254): a, c, t, g, unknown or other
  modified_base (312)..(312): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggacaaacgcccctaagtccctgattcttttcnggatccactttgaagagtggagtcccagcccaggtcagcggcagtggtctgggacatnttcactctcaccatcagcagcctgcccagctggatatttccgcgtaacttatacctcgacctaaactaactttactttacttttttacttacccgttaacgttacgggtttttacgggaccggtaacgggggtaaaccctaagggtaccgtagggaacgtaacgtaacgtaaaacgggtaaaccgttgggggtacggtacgttacgacccgtacctaacgttccgttcggtttcccttacctaccgtttccccgtttaccccgtccttaactttcccggttagttaacttaacgtttaaaccgttaacgttcggttcgttacgggtaacggggtccggggtaaccggttacggggaccggttaaacgggtccggaacctaagg

SEQ ID NO: 435105 - DNA, 707 bp, Homo sapiens
  misc_feature: GZ8MTXP01BMBB3.44.75.G09.1.454.CMB.2.raw
  modified_base (260)..(260): a, c, t, g, unknown or other
  modified_base (313)..(313): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacgttgccgggcgagtcgccgactattaggtacttttttggccttggtttcagcaggagccgtggacaaacgcccctaagtccctgtattctttnggtactccatttgaagtgtggactcccagcctaggtcaggcggctagtggtcngggacactatttcactctacacatcagcagcctgcccagtcgtggaactacgtttaccgacgttaactttaattaccctacggaacccctaaaacttaaactttactttttaccttttttaacttacccgtttaaccgttagggttttcgggacccgtaaagggggtaaccctaaagggtcgtagggaacgttaagtaaccgaaaagggtacgttggggtaacggtccttacgaccgttaaacccgttcgttcgttacgttaccctttccgtacccgtttccccgttcccgaccttaacgttaccgttagttaactttaacgtaacgttcgttacggttcgttacgggaacgggtccgggtcgtacgggtacggttacgggtccgaacggtaag

SEQ ID NO: 435106 - DNA, 663 bp, Homo sapiens
  misc_feature: GZ8MTXP01AQIDE.44.75.G09.1.454.CMB.2.raw
  modified_base (333)..(333): a, c, t, g, unknown or other
  modified_base (641)..(641): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtcctccgtcctaactgtctgcgtctattggggacagagtcaccatcacttgccgggcgagtgccgacattaggtacttttttggcctggtttcagcaggagcctggacaaacgcccctaagtccctgattcttttctggactcctactttgaagagtggactcccgagccgaggttcaggcggcaggttggttctgggacactatttccactcnccacatcagcagcctgcacgccgtaggacgtacttttccgaacgttaactttaacgttacctacgaccctaaaactaattttactttaccttttttttaacttacccgtttaacgttacggttttacgggtacccggtaacgggggtaacccgtaaacggtccgtagggtaacgaaacgttacgaaaacggtaaccgtggtcggggtctcggtaccaaccgttacttcgttcgtcctttcctaactttcccttaccccgtcctacttcctgttaatacttattacgttcgttgttcggaggtccgggngtcggacgaggcgtaacaagtg

SEQ ID NO: 435107 - DNA, 505 bp, Homo sapiens
  misc_feature: GZ8MTXP01AN9W5.44.75.G09.1.454.CMB.2.raw
  modified_base (250)..(250): a, c, t, g, unknown or other
  modified_base (263)..(263): a, c, t, g, unknown or other
  modified_base (268)..(268): a, c, t, g, unknown or other
  modified_base (300)..(300): a, c, t, g, unknown or other
  modified_base (315)..(315): a, c, t, g, unknown or other
  modified_base (403)..(403): a, c, t, g, unknown or other
  modified_base (453)..(453): a, c, t, g, unknown or other
  modified_base (477)..(477): a, c, t, g, unknown or other
  modified_base (490)..(490): a, c, t, g, unknown or other
  modified_base (502)..(502): a, c, t, g, unknown or other
  modified_base (505)..(505): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatctttngatccattgaagngtgancccagccagtcagcggcagtggtctgggacanatttcactctcaccntcagcagcctgcagctggatattcgctaatactactacaactattattcttttatctactagtttgaccgtaggaccaagcgtagganatacgaagacgtgcggctgacacatctcgtcttacacttcctacctcctntctgttatattactgtacgttcgnggacggtccgggngtcgcacggctngtn

SEQ ID NO: 435108 - DNA, 685 bp, Homo sapiens
  misc_feature: GZ8MTXP01D4KBY.44.75.G09.1.454.CMB.2.raw
  modified_base (259)..(259): a, c, t, g, unknown or other
  modified_base (312)..(312): a, c, t, g, unknown or other
  modified_base (346)..(346): a, c, t, g, unknown or other
  modified_base (363)..(363): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtgccgactagttaggtacttttttggccttggtttcagcaggagcctggacaaacgcccctaagtccctgtattctttcnggactcctactttgaagagtggatcccagccagtcagcgcagtgtctggacanttcactctcaccatcagcagctgccagctggatnttcgcgtaacttatacncacctaaatattatttacttttactccgttatagtttcggaccgtaggggaaccagtcgtagggaacgtagtaaccgaaaaggtaaccgttggggtacgggtacttacggaccgtaaccgtaacgttaccgtttcgtttaccctttaaccgtaaccgttttacccccgtttcccccgtaccccgttaaagtttacccgttacgttaaacgttttaaagtttaaacgttttaaccctttgggtttcccgttagggggttaaccgggcccgggggttccgttacggggtaccggttaaaacgggggtccccttaacgggtaaag

SEQ ID NO: 435109 - DNA, 662 bp, Homo sapiens
  misc_feature: GZ8MTXP01DB3BW.44.75.G09.1.454.CMB.2.raw
  modified_base (310)..(310): a, c, t, g, unknown or other
  modified_base (333)..(333): a, c, t, g, unknown or other
  modified_base (357)..(357): a, c, t, g, unknown or other
  modified_base (377)..(377): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagctggcaaacgcccctaagtccctgacttctttctggatccactttgaagtgtggacgtccccaggcctaggtttagcggctaggtggttcgngggacactatttcactctcaccntcagcacgcctgccacgcctaggngtactttccgacgtactttntactcgaaccctaaactaattattttctttttaactacccgttagttaggttttcgggaccgtagggggtaaccaaaggtccgttaagggaacgtacgtaacgaaaagggtaaccgttggtcggggtcgtcgtacctaccgtacttcctagttcctttaccaccgtttcccgttacccccgtacccttattccgttacgttaattaacgttacttaaccgtttgttacgttggttaacggtcccggggtgtaacgggtacgaaacggggcccgttaaacgaagtg

SEQ ID NO: 435110 - DNA, 543 bp, Homo sapiens
  misc_feature: GZ8MTXP01CAON0.44.75.G09.1.454.CMB.2.raw
  modified_base (252)..(252): a, c, t, g, unknown or other
  modified_base (498)..(498): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggacaaagcccctaagtccctgatcttttcnggatccactttgaagagtggagtccccagccaggttcagcggcagtggtctgggacacatttcactctcacatcagcagcctgccagcctggagtatttcgcgtaacttagttactgaccaaactaattactttacttttttactccgttactaggttttcggccgaggggtaccaagctagggagatacgaaaggactggggtgctgcactatctgttcttctacttccttcccgctaatcgttntacttatattacttgttcttgaaggcggcgtggcgaggcgcgaag

SEQ ID NO: 435111 - DNA, 687 bp, Homo sapiens
  misc_feature: GZ8MTXP01BX6RP.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtgccgacattaggtacttttttggccttggtttcagcaggagcctggacaaacgcccctaagtccctgtattcttttctggatcctactttgaagtagtggacgtcccagcctaggtcaggcggcagtggttctgggacactatttcactctcaccatcagcagcctgccagctggatatttcgacgtcttatacctacgacctaactaacttactttactttttacgttaccgttaacgtttacggtttacggtacccggtaacgggggtaaccgtaacggtacgtacggggtaagaacgttaaccggtaaaaacgggtaaccggttagggggttcgggtaaccgttcggaccctaacccttaacgttcctttacgtttcccgtttacctacctttcccctttaccccggtccttaaactttccttacggttaatttacttaaacgtttccgttggttcgttaccggtaagggcgggtcgtcgggacgttaacgggcgttaactaag

SEQ ID NO: 435112 - DNA, 620 bp, Homo sapiens
  misc_feature: GZ8MTXP01A2X3L.44.75.G09.1.454.CMB.2.raw
  modified_base (274)..(274): a, c, t, g, unknown or other
  modified_base (310)..(310): a, c, t, g, unknown or other
  modified_base (543)..(543): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagccgtggacaaacgcccctaagtccctgattcttttctggactccactttgaagnggtggacgtcccagccaggtcagcggcagttggtcngggacactattcactctcacatcagcacgcctgccgacgccgtaggacgtacgtttccgacgtaactttactaccgtacgacctaaactaatttactttacttttttactccgttacttacggttttcggaccgtacggggacctaacggtcgtacggaagaagtaacgaaagggtactgggggttacggcgtacgacgacctacgtcgtcgttactcctacttccgttcccnctcttcttgtaacttactacttacgttcgttcgttcgggaacggcgggttcgcgggtacgaacgggtcgaacgtaag

SEQ ID NO: 435113 - DNA, 520 bp, Homo sapiens
  misc_feature: GZ8MTXP01CX6MD.44.75.G09.1.454.CMB.2.raw
  modified_base (306)..(306): a, c, t, g, unknown or other
  modified_base (417)..(417): a, c, t, g, unknown or other
  modified_base (467)..(467): a, c, t, g, unknown or other
  modified_base (477)..(477): a, c, t, g, unknown or other
  modified_base (495)..(495): a, c, t, g, unknown or other
  modified_base (508)..(508): a, c, t, g, unknown or other
  modified_base (518)..(518): a, c, t, g, unknown or other
  modified_base (520)..(520): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttgggcctggtttcagcaggagcctggacaaacgccccctaagtccctgtattcttttctggatccactttgaagagtggagcccagccaggttcagcgcagttggtcnggacacatttcactctcaccatcagcagctgccagctggatattcgctaacttatactgacccaaataattattcttttatcgtactagtttgcagggtacaagctagganatacaaaggactgggtacggctgacacatcctgtcttcacttccctcccnccaattcttntaattatactacttgttnttgaaggcggtgngacgacgcgngn

SEQ ID NO: 435114 - DNA, 704 bp, Homo sapiens
  misc_feature: GZ8MTXP01BY0MB.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctattggggacagagtcaccatcacttggccgggcgagtgccgactattaggtacttttttggccttggtttcagcaggacgcctggacaaacgcccctaagtccctgtattctttctggactccactttgaagagtggactccagccaggtcaggcggctagtggtctgggacactatttcactctcaccatcagcacgctgcccacgcgtaggtactagtttaccgacgtaactttactacctacgaccctaaacttaatttacttttaccgttttttactacccgttaacgttacgggttttcgggacccggtaaggggggtaaacccctaagggtaccgttaagggggaaataacgtaaacggtaaaacggggtaaccgttgggggtacggggtaccttcggaccctaaccctaacgttcctttcggttacctttacctaacctttaccccgtttccccgccttaacgttacttaggtaaactttacgttacttaacgttcgttaccgttgggaacgggtccggggaacgttcgggacgttacgggccgttaagtaag

SEQ ID NO: 435115 - DNA, 698 bp, Homo sapiens
  misc_feature: GZ8MTXP01AD8RY.44.75.G09.1.454.CMB.2.raw
  modified_base (310)..(310): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgattctttctggattcctactttgaagtgtggactcccagcctaggtcacgcggctaggtggttcngggactactatttcactctcacatcgagcacgcctgccagcgtggactatttccgacgttaacttagttacctcgaaccctaaactaatttactttacctttttacgtacccgttaacgttacggttttcgggaccggtaacgggggtaacctaaggtccgttagggaacgtacgttaaaccggaaaagggtaaccgttagggggttacggtacgttacggaaccctaacccgtactttccgttcgtttaccctttacctaccgtttccccttccccggtaccctaacttaccgttaggtaactttaacgttaacttacccgttggttccgttagggtaaccggggtccggggtccgttacggggaccgaacggggtccgaacgtaag

SEQ ID NO: 435116 - DNA, 770 bp, Homo sapiens
  misc_feature: GZ8MTXP01C07MM.44.75.G09.1.454.CMB.2.raw
  modified_base (324)..(324): a, c, t, g, unknown or other
  modified_base (342)..(342): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcgccgactattaggtacttttttggccttggtttcagcaggagcctggacaaacgcccctaagtccctgtattctttctggtactcctactttgaagtggtcggacgtccccagcctaggttcgaggcggcgtaggttggttcgngggacactatttcactcncaccatcagcagcctgcccagtccgtggacgtagtttaccggacgttaatttaacttactaacgtaccctaaactaacttttactttacctttttttaacttaccgtttaaccggtttacgggttttcgggaacccggtaaacgggggtaacctaaacgggtaccggttaagggtaaacgtaacgttaaaacgggtaaaaacgggttacccgttaggggggttacggtaccgttacggaacctaacccgtatttcccgttacgttttacccttacccgtaaccctttccccgtttacccccgtaccttaacttaccgtttacgtaaactttaacgtttaaacttccgggtttacggttccggttaacggggcggggtacccggggtcgttaacccgggggtagaaacccgggggttcgttaacgtaag

SEQ ID NO: 435117 - DNA, 576 bp, Homo sapiens
  misc_feature: GZ8MTXP01AEC8N.44.75.G09.1.454.CMB.2.raw
  modified_base (492)..(492): a, c, t, g, unknown or other
  modified_base (512)..(512): a, c, t, g, unknown or other
  modified_base (575)..(575): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggcctggtttcagcaggagccgtggacaaacgcccctaaggtccctgtattcttttctggacttcctacgtttggaagtaggtggacgtccccagcctaggtcaggcggcagttggtctgggacactatttcactctcacatcagcagcctgccacgcgtggatatttcgcgttaacttactactgaccctaataagttactttactttttactccgttattacggtttcggaccgaggggtaaccaagtcgtaggagatacgaaaggtactggggtggactcgacacctntctcgttctcctctcctccnctaatcttatacttacgttactgttcgttcgttggcggtcggtcgtcggacgacggtcgaagng

SEQ ID NO: 435118 - DNA, 533 bp, Homo sapiens
  misc_feature: GZ8MTXP01E5COW.44.75.G09.1.454.CMB.2.raw
  modified_base (254)..(254): a, c, t, g, unknown or other
  modified_base (309)..(309): a, c, t, g, unknown or other
  modified_base (467)..(467): a, c, t, g, unknown or other
  modified_base (482)..(482): a, c, t, g, unknown or other
  modified_base (490)..(490): a, c, t, g, unknown or other
  modified_base (514)..(514): a, c, t, g, unknown or other
  modified_base (522)..(522): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctgggtttcagcaggagctggacaaagcccctaagtccctgtatcttttcnggactccactttgaagagtgagtcccagccaggtcagcgcagtggtctgggacanatttcactctcaccatcagcagcctgccagctaggagtactttcgacgtaactttatactgaccaaactaattactttctttttataccgtactagttttcggaccgaggggaccaaggctaggagatacgaaaggactgggtgctgaccaccatctntacttctatcctccnctaactcngtattatatacttggttcttaggngcgggtcngcgagcgcgaa

SEQ ID NO: 435119 - DNA, 686 bp, Homo sapiens
  misc_feature: GZ8MTXP01D403P.44.75.G09.1.454.CMB.2.raw
  modified_base (311)..(311): a, c, t, g, unknown or other
  modified_base (381)..(381): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtattctttctggactccactttgaagtagtggacgtccagccaggttcagcggctaggtggttcngggacactatttcactctcaccatcagcagcctgccagctaggactacgtttcgacgtaacttattaccncgacctaaactaattacttttactttttactaccgttaacgttaggttttcgggacccgtaacgggggaaccctaaaggtcgtagggaacgtaaacgtaacggtaaaaggtaaccgtggggttacgggtaccgtacggtacccaaccgttaacttccgtttacggttacctttacctaactttccccgttaccccgtaccctaacgttccgttacgtaaactttagtttaaacgttaacttcggtttcgttacgggaacggggttccgggaacggttcgggacggttaacgggtaacgctaaagg

SEQ ID NO: 435120 - DNA, 664 bp, Homo sapiens
  misc_feature: GZ8MTXP01BGK5M.44.75.G09.1.454.CMB.2.raw
  modified_base (256)..(256): a, c, t, g, unknown or other
  modified_base (274)..(274): a, c, t, g, unknown or other
  modified_base (309)..(309): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgactattaggtacttttttggcctggttcagcaggagcctggacaaacgcccctaagtccctgtattctttcnggactcctactttgaagngtggacgtccccagccaggtcagcggcagtggtcngggacactatttcactctcaccatcagcagcctgccagctggagtactttcgacgtaacttatacctgaacctaactaattactttcttttttactaccgttacttaggtttcgggaccgtaagggggtaacccaaggtccgttagggaagtacgttaacgaaaacgggttaccgtgggggttacggggtccttacggacccgtacctaacgttccgttacgtttacccttactacccttacccgtttccccgaccttaacgttcccttagtacttaacgttaaactacgttcgttccttaaggggaacgggtccgggggttcgtacggggacccgaaggggtccttcggtaaag

SEQ ID NO: 435121 - DNA, 589 bp, Homo sapiens
  misc_feature: GZ8MTXP01EWWHD.44.75.G09.1.454.CMB.2.raw
  modified_base (254)..(254): a, c, t, g, unknown or other
  modified_base (366)..(366): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgatcttttcnggatccactttgaagagtggagcccagccaggttcagcggcagtggtctgggacacattcactctcacatcagcagcctgccagctaggagatttcgacgtaacttattacngacctaaactattattactttttactccgttactaggttttcggaccgagggggtaacccaaggctagggagtaacgtaacgaaaagggtaactggggtacgggctacggacctaacccattcctagttccttactcttccctccccgtcctaactcttatattaataacttcttacgttcgttggaacgggcggggtctcggggacgaagggtccgcgtaag

SEQ ID NO: 435122 - DNA, 501 bp, Homo sapiens
  misc_feature: GZ8MTXP01B058Z.44.75.G09.1.454.CMB.2.raw
  modified_base (251)..(251): a, c, t, g, unknown or other
  modified_base (414)..(414): a, c, t, g, unknown or other
  modified_base (418)..(418): a, c, t, g, unknown or other
  modified_base (420)..(420): a, c, t, g, unknown or other
  modified_base (422)..(422): a, c, t, g, unknown or other
  modified_base (436)..(436): a, c, t, g, unknown or other
  modified_base (445)..(445): a, c, t, g, unknown or other
  modified_base (459)..(459): a, c, t, g, unknown or other
  modified_base (462)..(462): a, c, t, g, unknown or other
  modified_base (465)..(465): a, c, t, g, unknown or other
  modified_base (474)..(474): a, c, t, g, unknown or other
  modified_base (481)..(481): a, c, t, g, unknown or other
  modified_base (483)..(483): a, c, t, g, unknown or other
  modified_base (485)..(485): a, c, t, g, unknown or other
  modified_base (490)..(490): a, c, t, g, unknown or other
  modified_base (492)..(492): a, c, t, g, unknown or other
  modified_base (499)..(499): a, c, t, g, unknown or other
  modified_base (501)..(501): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccacttgaagagtggagccccagccaggttcagcggcagtggttctggggacacatttcactctcaccatcagcagcctgccaggctggagatttcgcgcttaattactgaccaaacaatatctttttatccgtactagtttggtcaggggaccaaggntganananaagaagaggtgtgngcacatctntctctctctcctcnctnttntattatatnttgttcngngnggcgngngacgcgngn

SEQ ID NO: 435123 - DNA, 711 bp, Homo sapiens
  misc_feature: GZ8MTXP01A424F.44.75.G09.1.454.CMB.2.raw
tcagacagtatatacacgaccggtgctcgatttagtatagacatcaggggtctgcttcagctgtgagcgcagaaggcaggactcgggacaatcttcatcatgacctgctcccctctcctcctcacccttctcattcactgcgcagggtcctgggcccagtctgcattgacgcagcccgccctcagtgtctcgccggccccaggacagagcgtcgccatctcctgctactaggaaaccaactaccaactagttggtacgtaatcatagttacaagtacggtaaaccaaaaacgtcgacgtggacctaccggacccctaaagtccctactatttatagaagtaactcgttaacgaccgtcccacgtcggactctccgtacgacccgtaactttccgtctcgtacccttacgttaacgttcgtacggtaacctttacaacgtcccgtactttcgggacctagttcccgaacccgggtactaccgagaccgtagggtaacgacggtacgggaccctaagttaacgtttacgtttgggttaacggggttccgttacggggacctttccgtacggttcccggtttggggttcgggggtttacgggggtttccgggcggggaaccggggtcccgacgtcggtaacccggacgtttaacgaccgtaaccggacccgtaacggtccgtccccggaccccggttccggcctttaaccccgg

SEQ ID NO: 435124 - DNA, 723 bp, Homo sapiens
  misc_feature: GZ8MTXP01A56KM.44.75.G09.1.454.CMB.2.raw
  modified_base (257)..(257): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtattcttttcnggactcctactttgaagagtcggacgtcccagccaggttcaggcggcaggttggttcgtggggactacgtactttccactcctcacctatccgagcagtccgtgccccaggtccgtggtacgtactttaccggaccgttaactttaacttacctacggtaaccctaaacttaacttactttttaccttttttaacgttacccgttaacgttaggttttacggtaccggaacggggtaaccggtaaccgtaggtacggtaagtaagtaacgtaaacgggtaacgttacggggttacggtcgtacggcccgtaaccgtaacttcggtttaacgtttccttaccgttaaccgtttaccccgttccccgttccctaaccttaccttaccggttaaattaacgttaacttaacccgttaggttcgttacgggtcggtcggggtaacgttcgggacgaacggtcggctaagg

SEQ ID NO: 435125 - DNA, 547 bp, Homo sapiens
  misc_feature: GZ8MTXP01BV67C.44.75.G09.1.454.CMB.2.raw
  modified_base (250)..(250): a, c, t, g, unknown or other
  modified_base (502)..(502): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtcccagccaggtcagcggcagtggttctggggacacatttcactctcaccatcagcagctgccagctggagtatttccgcgtaactttatactcgaccaaactaatatttctttttatccgttactagtttcggaccgtaggggtaaccagtctgggacgagtacgaaaggacttggggtacggtctgcaccattctagttccttctacttccttccccgcaacgtcttntattatattacttgttcttgaaggtcgggctgggcaggtcgcgaa

SEQ ID NO: 435126 - DNA, 590 bp, Homo sapiens
  misc_feature: GZ8MTXP01ARIX9.44.75.G09.1.454.CMB.2.raw
  modified_base (313)..(313): a, c, t, g, unknown or other
  modified_base (318)..(318): a, c, t, g, unknown or other
  modified_base (330)..(330): a, c, t, g, unknown or other
  modified_base (416)..(416): a, c, t, g, unknown or other
  modified_base (526)..(526): a, c, t, g, unknown or other
  modified_base (554)..(554): a, c, t, g, unknown or other
  modified_base (582)..(582): a, c, t, g, unknown or other
  modified_base (589)..(589): a, c, t, g, unknown or other
tcagacagtatatacacgaccggtgctcgatttagtatagacatcagggacttaggggctttgccaggctcctgctgctctgtttccccggtgccgggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgattctttctggactcctactttgaagtagtggactcccagccgaggttcaggccggctaggtggttcnggacnctatttcactcncacatcagctacgcctagccacgccgtaggactatttccgaacgttactttgttacctgacctaaactattactttcttttttacnccgttacttggtttcggaccgtacggggactaaaggcgttaggacgtatacgtaaaggacttgggtacggacgttgacctacctatcgtcgttctactcttcccgtcccnctactctattatattacgtgtcgttagnggttacgccgggtgtcggacgacgggcngttaagng

SEQ ID NO: 435127 - DNA, 718 bp, Homo sapiens
  misc_feature: GZ8MTXP01AWPNL.44.75.G09.1.454.CMB.2.raw
  modified_base (254)..(254): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagctggacaaacgcccctaagtccctgattcttttcnggatccatttgaagagtggacgtcccagccgaggtcaggcgcaggtggttctggggacactatttccacttctacaccatcgagcacgtcctgcccaggtccgtggtagtacgtttccggacttaactttattacctcgaccctaaaattaactttcgtttttacctttttttaacgttacccgttaaccgtttacgggttttaccgggacccggtaacgggggtaaaccccgtaagggtacgtacggggtaaacgaagtaacccggtaaaagggtaccgttaggggggtcggtaccgtacggtaccctaaccgtaacgttcttcgttacctttccgtactttccccgtttaccccggcctaactttccgagttaaacttacgttaaacttacccgttgttcggttacgggtcgggtaccgggttcggtaacgggtcgggttaaacgggccggttaacgtaagg

SEQ ID NO: 435128 - DNA, 720 bp, Homo sapiens
  misc_feature: GZ8MTXP01DMCQM.44.75.G09.1.454.CMB.2.raw
  modified_base (642)..(642): a, c, t, g, unknown or other
  modified_base (714)..(714): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgactattaggtacttttttggccttggtttcagcgagggacgcctggacaaacgtcccctaagtccctgtacttcttttctgggtacttccctaacgtttggaaaggtggtacggacgtccccaggccctaggttaccaggcggtcgtaggtcgggtttacgtcggggaacctacgtactttaccacttcctacaccctatccagacacgctcgacccacggtccgtggtacgttacgtttaccggacgttaactttacgtttaaccgtacgtaaccctaaacgttaactttacttttaccttttttacgttccgtttaacgttacgggttttacggaccggtaacgggggtaacctaagggtccgttaaggaacgacgtaacggaaaaggtaccgttggggtacgggtacttacgacctaacttcgtacttcgttcctacttaccgttcccgtacccnctaacttcttagtattacgttattacgttggttcttgggaacggtcgggtcgtacgggcgttaacggtccgngtaagg

SEQ ID NO: 435129 - DNA, 507 bp, Homo sapiens
  misc_feature: GZ8MTXP01AIJJ6.44.75.G09.1.454.CMB.2.raw
  modified_base (218)..(218): a, c, t, g, unknown or other
  modified_base (252)..(252): a, c, t, g, unknown or other
  modified_base (349)..(349): a, c, t, g, unknown or other
  modified_base (373)..(373): a, c, t, g, unknown or other
  modified_base (392)..(392): a, c, t, g, unknown or other
  modified_base (468)..(468): a, c, t, g, unknown or other
  modified_base (472)..(472): a, c, t, g, unknown or other
  modified_base (477)..(477): a, c, t, g, unknown or other
  modified_base (498)..(498): a, c, t, g, unknown or other
  modified_base (506)..(507): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggancctggcaaagcccctaagtccctgattcttttcnggatccactttgaagagtggagtccccagccaggttcagcggcagtggttctggggacacatttcactctcaccatcagcagcctagccagctgganatttcgcgcttattactgaccaanaatattcttttatccgtanagtttggcctaggggaccaagctggagatacaaaggaactgggtaggctgcaccatctgttctcatcttacccgcnctcngattnaatacttgttcttgaagcggntgcagcgnn

SEQ ID NO: 435130 - DNA, 669 bp, Homo sapiens
  misc_feature: GZ8MTXP01EPGPE.44.75.G09.1.454.CMB.2.raw
  modified_base (266)..(266): a, c, t, g, unknown or other
  modified_base (315)..(315): a, c, t, g, unknown or other
  modified_base (428)..(428): a, c, t, g, unknown or other
  modified_base (611)..(611): a, c, t, g, unknown or other
  modified_base (641)..(641): a, c, t, g, unknown or other
tcagacagtatatacacgaccggtgctcgatttagtatagacatcagggacttagggggctttgccaggctcctgctgctctgtttccccggtgccaggtgtgacatcgagatgacccagtcctccgtcctcactgtctgcgtctagttggggacagagtcaccatcacttggccgggcgagtcgccgactagttaggtacttttttggcctggtttcagcgaggagcctggacaaacgtcccctaagtccctgtacttctttcgnggtacttccgtatttaggaagtaggtcggacgtcccagcctaggtacgnggcggcgtaggtggtcgaggactacgtactttcacttcaccactatacgagtccacgtcctacgcctacggtcgtagggacttacgtttaccgacgttaactttacgttaacncgaaccctaattaactttactttacctttttactaccgttaacgttacggtttacggaccggtaagggggaacctaaaggtcgtaggtaagaacgtaaacgtaaaggtacgtagggggtacggtacctcgacctaacctcgttccttcgttaccttcctacttcccttcccacctaatcttanacttaagtcttacgttcgttcgttacgggnggtcggcgtcgacgacggtcaacgtaag

SEQ ID NO: 435131 - DNA, 504 bp, Homo sapiens
  misc_feature: GZ8MTXP02GWK2Y.44.75.G09.1.454.CMB.2.raw
  modified_base (484)..(484): a, c, t, g, unknown or other
  modified_base (487)..(487): a, c, t, g, unknown or other
  modified_base (504)..(504): a, c, t, g, unknown or other
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatcttttctggatccactttgaagagtggagtcccagccaggttcagcggcagtggttctgggacacatttcactctcaccatcagcagcctgccagcctggagatttcgcgacttattactgccaaacaatattctttttatccgttactagttttggcctaggggtaccaagctaggagatcaaaaggaactgtggctgcaccatctgtcttcatcttcccgcatctgactatatacttctntgngcggcgcgcgacgcgcn

SEQ ID NO: 435132 - DNA, 510 bp, Homo sapiens
  misc_feature: GZ8MTXP02I5VHX.44.75.G09.1.454.CMB.2.raw
  modified_base (488)..(488): a, c, t, g, unknown or other
  modified_base (491)..(491): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatcttttctggatccactttgaagagtggagtcccagccaggttcagcggcagtggttctgggacacatttcactctcaccatcagcagcctgccagcctggagatttcgcgtacttattactgcccaaacaattattcttttttaatcccgttactagttttggccaggggtaccaagctggagatcaaaggactgtaggctgcaccatctgtcttcatcttcccgctatctgatatatacttctntgngcggcgcgcgacgcgacag

SEQ ID NO: 435133 - DNA, 506 bp, Homo sapiens
  misc_feature: GZ8MTXP02HKSRK.44.75.G09.1.454.CMB.2.raw
  modified_base (251)..(251): a, c, t, g, unknown or other
  modified_base (469)..(469): a, c, t, g, unknown or other
  modified_base (485)..(485): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccacttgaagagtggagtcccagccaggtcagcggcagtggtctgggacacatttcactctcaccatcagcagcctgccagcctggagatttcgcgacttattactgccaaacaatattctttttatccgtactagtttggcctaggggaccaaagctaggagatacaaaaggaactgtggctgcaccatctgtcttctatctcctccactctnatatatacttctctgngcggcgcgacgacgacgacag

SEQ ID NO: 435134 - DNA, 634 bp, Homo sapiens
  misc_feature: GZ8MTXP02GQ4G9.44.75.G09.1.454.CMB.2.raw
  modified_base (302)..(302): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttctggatccactttgaagagtggagtcccagccaggttcagcggcagtggtcngggacacattcactctcaccatcagcagcctgccagcctggatactttcgcgtactttattactgaccctaataatttactttctttttactacccgttaacttaggttttcggaccgtaacgggggaccaaggtcgtaggagaacttaccgaaaaggtacgttaggtcggtctcggacctaacctacttccgttgttccttacctactttcccgtttaccccgacctaacttccgttacgtaactttaacttacttaacccgttcggttccgttagggaacgggtccgggggtcgttacgggaccggtaaacggggcccggtaacgtaacg

SEQ ID NO: 435135 - DNA, 521 bp, Homo sapiens
  misc_feature: GZ8MTXP02GZLOW.44.75.G09.1.454.CMB.2.raw
  modified_base (511)..(511): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgccagcctggagatttcgcgtacttattactgaccaaactaattattactttttttatcccgttaactagtttttcggcctagggggtacccaaagctgggaagatacgaaaaggactagtggctgcaccatctgtcttcatcctccgccatctgatatatactgtctgaagcggcngacgagcaca

SEQ ID NO: 435136 - DNA, 499 bp, Homo sapiens
  misc_feature: GZ8MTXP02FUWRG.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatctttctggatccactttgaagagtggagtcccagccaggttcagcggcagtggttctggggacacatttcactctcaccatcagcagcctgccagcctggagatttcgcgcttattactgcccaaacaatattctttttatccgttacagttttgcctaggggaccaagctggagatcaaaggactgtggctgcaccatctgtcttcatcttcccgccatctgatatatactgtctgaagcggcgtcgcgagcgca

SEQ ID NO: 435137 - DNA, 509 bp, Homo sapiens
  misc_feature: GZ8MTXP02HH0YG.44.75.G09.1.454.CMB.2.raw
  modified_base (432)..(432): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgccagcctggagatttcgcgacttattactgccaacaatattctttttatccgttactagtttggccaggggaccaagctggagatcaaaggactgnggctgcaccatctgtcttcattccttcccgcctatctgtactatatactctctgtaagcggcgtcgcgacgacgcag

SEQ ID NO: 435138 - DNA, 499 bp, Homo sapiens
  misc_feature: GZ8MTXP02JI108.44.75.G09.1.454.CMB.2.raw
  modified_base (380)..(380): a, c, t, g, unknown or other
  modified_base (456)..(456): a, c, t, g, unknown or other
tcagacagtatatacacgaccggtgctcgatttagtatagacatcagggacttaggggctttgccaggctcctgctgctctgtttccccggtgccaggtgtgatatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgccagcctgagatttcgcgcttatactgccaacaatatctttttancgtacagtttgcagggacagctgagatcaaagaatagtgcgtgcaccactctgtcttctatcttccccgcactctntactatactactcgtctgaagcggacgtcgacgacgacgacag

SEQ ID NO: 435139 - DNA, 507 bp, Homo sapiens
  misc_feature: GZ8MTXP02ITY7Z.44.75.G09.1.454.CMB.2.raw
  modified_base (251)..(251): a, c, t, g, unknown or other
  modified_base (302)..(302): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcgcttgccgggcgagtgccgacattaggacttttttggcctggtttcagcaggagcctggcaaagcccctaagtccctgatcttttcnggatccactttgaagagtggagtcccagccaggttcagcggcagtggttcngggacacatttcactctcacccatcagcagcctgccagcctggagatttcgcgactttattactgcccaacaattattctttttatccgttactagtttggccaggggaccaagctggagatcaaaggaactgtggctgcaccatctgtcttcatccttcccgctactctgatatatactgtctgaagcggctggcaaggcgcag

SEQ ID NO: 435140 - DNA, 499 bp, Homo sapiens
  misc_feature: GZ8MTXP02GEF9I.44.75.G09.1.454.CMB.2.raw
  modified_base (498)..(498): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctggggacacatttcactctcaccatcagcagcctgccagcctggagatttcgcgacttatactgccaacaatatctttttaatccgtactagtttgcctaggggaccaagctgagatcaaaggaactgtggctgacaccatctgtcttcatcttcccgcatctgactatatactgtctgaagcgggctcgacgagcana

SEQ ID NO: 435141 - DNA, 590 bp, Homo sapiens
  misc_feature: GZ8MTXP02G0SFP.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctggggacacatttcactctcaccatcagcagcctgccagcctggatatttcgcgtactttattactcgacccaaataattatttccttttttatcccgttaacttagttttcggaccgtagggggaccaaggcgttagggaagacgtacgaaaagggtaccttaggtacggtctaggaccaacctattccttgtccttctacttccgttccccgcctacttcctagtacttactacttacgttcgtcgttaggaacggtcgggtacgtcggaccgaaggccgactaag

SEQ ID NO: 435142 - DNA, 512 bp, Homo sapiens
  misc_feature: GZ8MTXP02HH7L9.44.75.G09.1.454.CMB.2.raw
  modified_base (440)..(440): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgccagcctggagatttcgcgactttattactgaccaacaatattctttttatccgtactagttttggcctaggggaccaagctggagatcgaaaggaactgtggntgcacatctgtcttcatccttcccgctatcctgtatatatactcgtctgtaagcggcgtcggcgacgcgcag

SEQ ID NO: 435143 - DNA, 507 bp, Homo sapiens
  misc_feature: GZ8MTXP02FOI3I.44.75.G09.1.454.CMB.2.raw
tcagacagtatatacacgaccggtgctcgatttagtatagacatcagggacttaggggctttgtcaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgccagcctggagatttcgcgtacttattactgaccaacaattattcttttttaatccgttactagttttggcctaggggtaccaagctggagatcaaaggaactgtggctgcacatctgtcttcatctcccgcatctgactatactactgtctgaagtcggctggcaaggcgca

SEQ ID NO: 435144 - DNA, 508 bp, Homo sapiens
  misc_feature: GZ8MTXP02FL2R6.44.75.G09.1.454.CMB.2.raw
  modified_base (346)..(346): a, c, t, g, unknown or other
  modified_base (423)..(423): a, c, t, g, unknown or other
  modified_base (471)..(471): a, c, t, g, unknown or other
  modified_base (484)..(484): a, c, t, g, unknown or other
  modified_base (487)..(487): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgcccagcctgganatttcgcgtacttattactgacccaaacaattattcttttttatccgttactagtttgctaggggaccaagctgganatcgaaagactgtggctgcaccatctgtcttcatcttcccgcactctntatatatactctntgngcggcgtcgacgacggcgcag

SEQ ID NO: 435145 - DNA, 522 bp, Homo sapiens
  misc_feature: GZ8MTXP02FULHT.44.75.G09.1.454.CMB.2.raw
  modified_base (456)..(456): a, c, t, g, unknown or other
  modified_base (466)..(466): a, c, t, g, unknown or other
  modified_base (487)..(487): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttctggatccactttgaagagtggagtccccagccaggttcagcggcagtggttctgggacactatttcactctcacccatcagcagcctgcccagcctgggagtatttccgcgtaccttattacctgaccctaactaaattattactttttatccgttactagttttggccgtaggggaccaagctggagatacaaaggactgtggntgcacatctntcttcatctcccgctactctnatatactactgtctgaagcggctggcaggcgacag

SEQ ID NO: 435146 - DNA, 519 bp, Homo sapiens
  misc_feature: GZ8MTXP02ISSLV.44.75.G09.1.454.CMB.2.raw
  modified_base (252)..(252): a, c, t, g, unknown or other
  modified_base (481)..(481): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttcnggatccactttgaagagtggagtcccagccaggttcagcggcagtggttctgggacacatttcactctcaccatcagcagcctgccagcctggagtatttccgcgtactttattactgaccaaacaattactttctttttatccgttactagtttggccgaggggaccaagctaggagatacaaaggaactgtggctgcacagtctgtctctatcctcccgctactctnatatatactgtactgaagcggcgtggacgacgcgacag

SEQ ID NO: 435147 - DNA, 526 bp, Homo sapiens
  misc_feature: GZ8MTXP02JRW5B.44.75.G09.1.454.CMB.2.raw
  modified_base (251)..(251): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtccccagccaggttcagcggcagtggttctgggacacatttcactctcaccatcagcagcctgcccagcctggagtatttcgcgtctttattactgaccaaactaattatttcctttttatcccgttactagttttcggcctagggggaccaagctaggagatacgaaaggactagtggctgcacatctgtcttcacttcttcccgcctatctgtactatactactcgtctgaagcggcgtggcaaggcagag

SEQ ID NO: 435148 - DNA, 519 bp, Homo sapiens
  misc_feature: GZ8MTXP02GZ4ON.44.75.G09.1.454.CMB.2.raw
  modified_base (502)..(502): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctggggacacatttcactctcaccatcagcagcctgccagcctggagtatttccgcgtacttattaactgacccaaactaaattatttctttttatccgttactagtttcggccgagggggtaccaagctagggagatacgaaaggactaggtgctgcacagtctgtctcactcttcccgcactctgatatatactgtctgngcggctggacagcgcag

SEQ ID NO: 435149 - DNA, 526 bp, Homo sapiens
  misc_feature: GZ8MTXP02JETB6.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatcttttctggatccactttgaagagtggagtcccagccaggttcagcggcagtggttctgggacacatttcactctcaccatcagcagcctgcccagcctggagtatttcgcgtacttattactgaccaaactaattacttctttttatccgttactagttttggccaggggaccaagctggacgatacgaaaggactgtagctgcaccatctgtcttcattccttcccgcctactctgattactatacttgtctgaacgtcgggactcgggacacggcgacag

SEQ ID NO: 435150 - DNA, 507 bp, Homo sapiens
  misc_feature: GZ8MTXP02H647F.44.75.G09.1.454.CMB.2.raw
  modified_base (253)..(253): a, c, t, g, unknown or other
  modified_base (449)..(449): a, c, t, g, unknown or other
  modified_base (467)..(467): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagccccctaagtccctgatctttttcnggatccactttgaagagtggagtcccagccaggtcagcggcagtggtctgggacacatttcactctcaccatcagcagcctgccagcctggacgatttcggctcttattactgaccaaacaattattctttttatccgtactagtttgccaggggtaccaagctggagatacaaaggactgtggctgcaccatctntctctctctcctctactntatatatactactctcgtgaagcggcgcgacgacgcgaca

SEQ ID NO: 435151 - DNA, 502 bp, Homo sapiens
  misc_feature: GZ8MTXP02J0913.44.75.G09.1.454.CMB.2.raw
  modified_base (252)..(252): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtcccctgatcttttcnggatccactttgaagagtggagtcccagcccaggttcagcggcagtggttctggggacacatttcactctcaccatcagcagcctgccagccctggagatttcgcgtcttatactgccaacaatattctttttatccgtactagttttgccgagggaccaagctggagatcaaagactagtgctgcacatctgtctcatccttccgcctatctgatactatactcgtctgaagcggctcggcaggcgcag

SEQ ID NO: 435152 - DNA, 505 bp, Homo sapiens
  misc_feature: GZ8MTXP02JZZ1T.44.75.G09.1.454.CMB.2.raw
  modified_base (251)..(251): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgccagcctggagatttcgcgcttatactgaccaaacaattattctttttatccgttactagttttggcctaggggaccaagctaggagatacaaaggactgtggctgcacatctgtcttcatcttccgcctatctgatatatactgtctgaagcgggctggcaggcgacag

SEQ ID NO: 435153 - DNA, 506 bp, Homo sapiens
  misc_feature: GZ8MTXP02GIZB9.44.75.G09.1.454.CMB.2.raw
  modified_base (348)..(348): a, c, t, g, unknown or other
  modified_base (434)..(434): a, c, t, g, unknown or other
  modified_base (436)..(436): a, c, t, g, unknown or other
  modified_base (467)..(467): a, c, t, g, unknown or other
  modified_base (478)..(478): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctggggacacatttcactctcacccatcagcagcctgcccagcctgganatttcgcgtacttattactgaccaacaatattctttttatccgttactagtttggccaggggaccagctggagatacaaagactgngntgcaccatctgtcttcatctcccgctatctnatatactactntctgaacgcgggctggcgaaggcgctag

SEQ ID NO: 435154 - DNA, 517 bp, Homo sapiens
  misc_feature: GZ8MTXP02ISNAR.44.75.G09.1.454.CMB.2.raw
  modified_base (254)..(254): a, c, t, g, unknown or other
  modified_base (463)..(463): a, c, t, g, unknown or other
tcagacagtatatacacgaccggtgctcgatttagtatagacatcagggacttaggggctttgccaggctcctgctgctctgtttccccggtgccaggtgtgacatcgagatgaccccagtctccgtcctcactgtctgcgtctattggggacagagtcaccatcacttgccgggcgagtgccgacattaggactttttttgggcctggtttcagcaggagcctggcaaagcccctaagtccctgatcttttcnggatccactttgaagagtggagtcccagccaggttcagcggcagtggttctgggacactatttcactctcaccatcagcagcctgccagcctggatatttccgcgtacttattactgacctaaacaattatttctttttatccgttactagtttggcctaggggaccaagctggagatacaaaggaactgtagctgcaccatctgtctnatcctccgcctatctgactatactactcgtctgaagcggctggcaaggcgacag

SEQ ID NO: 435155 - DNA, 526 bp, Homo sapiens
  misc_feature: GZ8MTXP02GUU2V.44.75.G09.1.454.CMB.2.raw
  modified_base (427)..(427): a, c, t, g, unknown or other
  modified_base (444)..(444): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgccagcctggagtatttcgcgtacttattactgacccaaacaattattctttttatccgttactagtttggccaggggtaccaagctggaganacgaaaaggactgtggntgcaccatctgtcttcattcctcccgcctactctagacttatacttactgtctgaacggtcgggctcgggcaacggcgcaag

SEQ ID NO: 435156 - DNA, 523 bp, Homo sapiens
  misc_feature: GZ8MTXP02FRA56.44.75.G09.1.454.CMB.2.raw
  modified_base (252)..(252): a, c, t, g, unknown or other
  modified_base (473)..(473): a, c, t, g, unknown or other
  modified_base (499)..(499): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggatccactttgaagagtggagtcccagccaggttcagcggcagtggttctggggacacatttcactctcaccatcagcagcctgccagcctggagtatttcgcgtacttattactgcccaaactaattacttcttttttaatccgttactagttttggacctaggggaccaagctaggagatcaaagactgtggctgcaccatctgtcttcatcttcccnctactctatactatactctcgtctgngcggacgtcggacgacggcgacag

SEQ ID NO: 435157 - DNA, 491 bp, Homo sapiens
  misc_feature: GZ8MTXP02FGXME.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaagcccctaagtccctgatctttctggatccactttgagagtggagtcccagccaggttcagcggcagtggttctgggacacatttcactctcaccatcagcagcctgccagcctggagatttcgcgactatactgccaacaatatctttttatccgtacagtttgcaggggaccaagctggagatcaaaggactgtggctgcaccatctgtcttcaatcttcccgccatctgatatatactgtctgaagcgggctggcaaggcgca

SEQ ID NO: 435158 - DNA, 501 bp, Homo sapiens
  misc_feature: GZ8MTXP02F9PU4.44.75.G09.1.454.CMB.2.raw
  modified_base (500)..(500): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgagagtggagtcccagccaggttcagcggcagtggttctgggacacatttcactctcaccatcagcagcctgccagcctggagatttcgcgtacttattactgccaacaatatcttttttatccgttactagttttggccaggggaccaagctggagatcaaaggaactgtggctgcaccatctgtcttcatcttccgctactctgatatatactgtctgaagtcgggctggcaggcana

SEQ ID NO: 435159 - DNA, 525 bp, Homo sapiens
  misc_feature: GZ8MTXP02IY9H9.44.75.G09.1.454.CMB.2.raw
  modified_base (250)..(250): a, c, t, g, unknown or other
  modified_base (296)..(296): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtgagtcccagccagtcagcgcagtggtcngggacacatttcactctcaccatcagcagcctgccagcctggacgtatttcgcgtactttattacctgaccaactaattattactttttactacctactagtttcgaccgaggggacagcgtggagagtacaaaggaactggtagctagccaccatctagtcttcacttcctcccgcctactctagatatatactcgtcgtgaacgcggactcgggacagggcacgtag

SEQ ID NO: 435160 - DNA, 518 bp, Homo sapiens
  misc_feature: GZ8MTXP02IUXWF.44.75.G09.1.454.CMB.2.raw
  modified_base (251)..(251): a, c, t, g, unknown or other
  modified_base (479)..(479): a, c, t, g, unknown or other
  modified_base (481)..(481): a, c, t, g, unknown or other
  modified_base (495)..(495): a, c, t, g, unknown or other
  modified_base (498)..(498): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctggggacacatttcactctcacccatcagcagcctgccagcctggagatttcgcgactttattactgacccaacaaattattcttttttatccgttactagttttggccctaagggggaccaagctggagatcaaaggaactgtggctgcaccatctgtcttcatctcccgccacttntntatatatactcgtntgngcggcgtcgcgacgcgacga

SEQ ID NO: 435161 - DNA, 588 bp, Homo sapiens
  misc_feature: GZ8MTXP02JXTE1.44.75.G09.1.454.CMB.2.raw
  modified_base (250)..(250): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtccccagccaggtcagcggcagtggttctgggacacatttcactctcaccatcagcagcctgcccagccgtggatatttccgcgtactttatactcgaccaaacaattactttctttttatcccgttacttagttttcggaccgtaagggggtacccaaggcgtagggaagtacgtaacgaaaaggtaactggtcgtcgtacgacctaacctacttcgttcttcttactacttcccttacccgcctactcctagtacttatacttacgtcgttcgtaggaacggtcgggtcgtcggacgaacgggccgacgtaacg

SEQ ID NO: 435162 - DNA, 510 bp, Homo sapiens
  misc_feature: GZ8MTXP02FJFL4.44.75.G09.1.454.CMB.2.raw
  modified_base (251)..(251): a, c, t, g, unknown or other
  modified_base (347)..(347): a, c, t, g, unknown or other
  modified_base (426)..(426): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtccccagccaggttcagcggcagtggttctgggacacatttcactctcaccatcagcagcctgccagcctgganatttcgcgtacttatactgacccaactaattattcttttttatccgttactagttttggctaggggaccaagctagganatacaaaggactggtggctgcaccatctgtcttcatcttcccgccatctgatatactacgtgtctgaagcggcgtgcgagcgca

SEQ ID NO: 435163 - DNA, 508 bp, Homo sapiens
  misc_feature: GZ8MTXP02HNYIC.44.75.G09.1.454.CMB.2.raw
  modified_base (251)..(251): a, c, t, g, unknown or other
  modified_base (423)..(423): a, c, t, g, unknown or other
  modified_base (468)..(468): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgccagcctggatatttcgcgtactttattactgacctaactaatattcttttatccgtatagtttgcgaggggtaccaagtctggaganacaaagactgtgctgcaccatctgtcttcatcctccgctactctnactatactactgtctgaagcggcgtcggcgacgtcgacag

SEQ ID NO: 435164 - DNA, 510 bp, Homo sapiens
  misc_feature: GZ8MTXP02HTHN3.44.75.G09.1.454.CMB.2.raw
  modified_base (252)..(252): a, c, t, g, unknown or other
  modified_base (446)..(446): a, c, t, g, unknown or other
  modified_base (470)..(470): a, c, t, g, unknown or other
  modified_base (478)..(478): a, c, t, g, unknown or other
  modified_base (492)..(492): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgatcttttcnggatccactttgaagagtggatcccagccaggttcagcggcagtggtctgggacacatttcactctcaccatcagcagcctgcccagcctggagatttcgacgtactttattaactgaccctaaacaattatttctttttatccgttactagttttgcctaggggaccaagctggagatacaaaggactgtggntgcaccatctgtctcatccgtccnctactctnatatatactgttcngaagcgctgcacgcgaca

SEQ ID NO: 435165 - DNA, 509 bp, Homo sapiens
  misc_feature: GZ8MTXP02G0D37.44.75.G09.1.454.CMB.2.raw
  modified_base (252)..(252): a, c, t, g, unknown or other
  modified_base (424)..(424): a, c, t, g, unknown or other
  modified_base (471)..(471): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggacaaagcccctaagtccctgatcttttcnggatccactttgaagagtggagtcccagccaggttcagcggcagtggttctgggacacatttcactctcaccatcagcagcctgccagcctggagtatttcgcgtactttattactgacccaactaattattctttttatccgttactagtttgccaggggaccagctgganatcaaaggactagtggctgcacatctgtctcatcctccgctactctnactatactactgtctgaagcggctcggcaaggcgacag

SEQ ID NO: 435166 - DNA, 808 bp, Homo sapiens
  misc_feature: GZ8MTXP02HN8HL.44.75.G09.1.454.CMB.2.raw
tcagacagtatatacacgaccggtgctcgatttagtatagacatcaggggtctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgccggccccaggacagagcgtcgccatctcctgctctaggaaacactccaacattggtcgtaatcatgttacataggtaaccaaaagtcgctggcctaccggacccctaaagtcctactatttatgaagtaatcttagaccggcccactcggactctctacgaccgtattcctctcgtcctacttaaacgttccttacggtaaactttccgaacgtccctaaaccgtttttcgggaccctaacgtacccgtaaacccgggtacccttacccgaaggtaacccgttacgggaaaccggaaacccggaacggggtaaccccgtaaagtttttaacccgtaagtttttacggggtttccgggggtaccgttttacgggggtaaacccttcccccggtaaacggttccccggttttgggggtttagggggtttccggggggtttttttaccgggggacccgggggtttaacgggggaaaccccgttaaaacggggtcccgtttaccgggtaaacccccgggtttcccggttaacgggggtaaccccttaaccggggacccccgttaaaacggggtccccgtttaccccgggtaccccccccggtttcggggtttaaccccccg

SEQ ID NO: 435167 - DNA, 612 bp, Homo sapiens
  misc_feature: GZ8MTXP02IE9I6.44.75.G09.1.454.CMB.2.raw
  modified_base (251)..(251): a, c, t, g, unknown or other
  modified_base (346)..(346): a, c, t, g, unknown or other
  modified_base (373)..(373): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcagagcccctaagtccctgattctttcnggatccactttgaagagtggagtcccagccaggttcagcgcagtggttctgggacacatttcactctcaccatcagcagcctgcagcctggagtntttcgcgtactttatactgaccctaanaaattacttcttttttacacccgttacttacgttttcggacccgtaggggtaccaagtcgtagggagtacgtacgtaaaagggtaaccgttaggttacggacttacggacctacccgtaacttaccgttcggttccttacctacttcccgttaccccgtacctacttcctataacttaattacttacgttcgtacctaaggtacggtacgggtcgtacggtaccgaaaggtccgtaacg

SEQ ID NO: 435168 - DNA, 521 bp, Homo sapiens
  misc_feature: GZ8MTXP02F443C.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttctggatccactttgaagagtggagtccccagccaggttcagcggcagtggttctgggacacatttcactctcaccatcagcagcctgccagcctggatatttcgcgtactttatactgaccaactaattattctttttatccgttactagttttcggccgtagggggaccaagcgtaggagatacgaaaggaactgtgctgacacatctgtcttcacttctcccgctatctgatatactactgtctgaagcggctcggacgaggcacgtag

SEQ ID NO: 435169 - DNA, 511 bp, Homo sapiens
  misc_feature: GZ8MTXP02HEAGX.44.75.G09.1.454.CMB.2.raw
  modified_base (251)..(251): a, c, t, g, unknown or other
  modified_base (472)..(472): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggtcagcgcagtgtctgggacacattcactctcaccatcagcagcctgccagcctggatatttcgcgtacttattactgaccaaactaatattctttttatccgtactagtttggcctaggggacctaagctggagatacgaaagaactgtaggctgcaccatctgtcttcactcttcccgcctatctanatatactactctctgaagcggcgtcggacgacgcgacag

SEQ ID NO: 435170 - DNA, 567 bp, Homo sapiens
  misc_feature: GZ8MTXP02H19SB.44.75.G09.1.454.CMB.2.raw
  modified_base (270)..(270): a, c, t, g, unknown or other
  modified_base (296)..(296): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggcctggtttcagcaggagcctggcaaagcccctaagtccctgattcttttctggatccactttgaagngtggagtcccagccaggttcagcggnagtggtctgggacactatttcactctcacatcagcagcctgccagcctggagtatttcgctacttattactcgaccaaactaattactttactttttactccgtacgttagttttcggaccgtaggggtacctaaggcgttaggaagtactaacgaaaggtaactggtggtctagaccacctattctcgttccttactacttccttcccgactactactgaacttatactacgtcgtacgtgaacggcggacgtcggcgaacggcgtacag

SEQ ID NO: 435171 - DNA, 540 bp, Homo sapiens
  misc_feature: GZ8MTXP02IKJVJ.44.75.G09.1.454.CMB.2.raw
  modified_base (251)..(251): a, c, t, g, unknown or other
  modified_base (300)..(300): a, c, t, g, unknown or other
  modified_base (316)..(316): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtgtcngggacacattcactcncaccatcagcagcctgccagcctggatatttcgactactttattactgaccctaacaattacttctttttatccgtacttagtttcgcgtaaggggactaagctaggagatacaaaggactggtgactgcaaccatctacgtcttacacttcctcccgctactcttacgacttaatacttactcgttactggaacgcgggacgtcggacgacggtacgactaag

SEQ ID NO: 435172 - DNA, 540 bp, Homo sapiens
  misc_feature: GZ8MTXP02GOVWV.44.75.G09.1.454.CMB.2.raw
  modified_base (250)..(250): a, c, t, g, unknown or other
  modified_base (388)..(388): a, c, t, g, unknown or other
  modified_base (518)..(518): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccacttgaagagtggagtcccagccaggttcagcggcagtggttctgggacactatttcactctcaccatcagcagcctgccagcctggagtatttcgcgtacttattactgaccaaatattattctttttacnccgttactagtttcggaccgtaggggaccaaggtcgtagggaagagtacgaaaaggtaactggtaggtctgacaccatctcgttcttcacttccttcccgctactctagtatactactacgtgtcgtagngcggcgtcggcgaaggcgacag

SEQ ID NO: 435173 - DNA, 526 bp, Homo sapiens
  misc_feature: GZ8MTXP02IH3MX.44.75.G09.1.454.CMB.2.raw
  modified_base (254)..(254): a, c, t, g, unknown or other
  modified_base (491)..(491): a, c, t, g, unknown or other
  modified_base (524)..(524): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggcctggtttcagcaggagcctggcaaagcccctaagtccctgattcttttcnggatccactttgaagagtggagtccccagccaggttcagcggcaggtggttctggggacacatttcactctcaccatcagcagcctgccagccctggagtatttccgcgtactttattactcgacccaaactaattatttctttttatccgtatagttttggccgaaggggaccaagctggagatacaaaaggactgtggctgcaccatctgtcttcacttcctcccgcctactctnattatatactgtctgaagcggctggcaggcganag

SEQ ID NO: 435174 - DNA, 539 bp, Homo sapiens
  misc_feature: GZ8MTXP02GSQCM.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctgggacacatttcactctcaccatcagcagccctgccacgcctggatatttcgacgtactttattactgaccaaactaattactttctttttactccgttactagttttcggaccgtagggggaccaagctaggagactacgaaagactggtgctgacacatctgttctcacttcctcccgctactctagtacttatacttactgtactgaaggcggtcgtaggcgaaggcgtacag

SEQ ID NO: 435175 - DNA, 562 bp, Homo sapiens
  misc_feature: GZ8MTXP02GX5N8.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggactccactttgaagagtggagtcccagccaggttcagcggcagtggtctgggacacatttcactctcaccatcagcagcctgcccagcctggagtatttcgacgtactttattactcgaccaaactaatttactttctttttaactccgttaacttagttttcggaccgtaagggggtaaccaaggcgtaggaagtagtacgaaaggacgtggtacggctgacacctatctcgttcttctacttccgttcccgctactcgtatactatactacgtgtctgaacgcggtcgtggacgacggccgacgag

SEQ ID NO: 435176 - DNA, 523 bp, Homo sapiens
  misc_feature: GZ8MTXP02GEUO8.44.75.G09.1.454.CMB.2.raw
  modified_base (508)..(508): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcccagcctggagatttcgcgtacttattactgacccaaacaattattactttttatccgttaactagttttggccgtagggggtaccaaggtctagggagatacaaaggactagtggctgacacatctgtcttcatccttccgcctatctgatatactactgtctgaagcggntcggacaggcgacag

SEQ ID NO: 435177 - DNA, 523 bp, Homo sapiens
  misc_feature: GZ8MTXP02FPA1X.44.75.G09.1.454.CMB.2.raw
  modified_base (488)..(488): a, c, t, g, unknown or other
  modified_base (522)..(522): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttctggatccactttgaagagtggagtcccagccaggtcagcggcagtgtctgggacactattcactctcaccatcagcagcctgccagcctggatatttcgcgtacttattactgaccaaacaattactttcttttttactccgttacttagttttcggaccgtaggggtacccaagtctaggagatacgaaaaggactaggtgctgacaccatctgtcttcactcctccgctactctnatatactactgtctgaagcggctggcgaggcgana

SEQ ID NO: 435178 - DNA, 640 bp, Homo sapiens
  misc_feature: GZ8MTXP02GF8Z1.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctggggacacatttcactctcacccgatacacgacgacgtccgtcgaccgaccgtccggtaggaacgttacgttccggacgttactttaacttacgtacgaacctaaaactaaatttactttttactttttacgtaccgttaacgtttaggttttacggaccgggtaacgggtaaaccgtaacgtcgttagggaacgtaacgtaaacgtaaaacggtacgtagggtcggttcgtacggacctaacctaacttcgttacttcttactacttacccgttcccactactctatacttataacttacgtcgtgtagcggcggtcggtacggacgacggcacgtag

SEQ ID NO: 435179 - DNA, 518 bp, Homo sapiens
  misc_feature: GZ8MTXP02G7JZJ.44.75.G09.1.454.CMB.2.raw
  modified_base (250)..(250): a, c, t, g, unknown or other
  modified_base (344)..(344): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatcttttcnggatccactttgaagagtggagtcccagccaggttcagcggcagtggtctgggacacatttcactctcaccatcagcagcctgccagcctgganatttcgcgactttattactgaccaaacaattattacttttttaatccgttaactagttttggcctagggggaccaagctagggagatacgaaaaggactgtaggctgcaccatctgtcttcactcttcccgcctatctgatatatactgtctgaagtcggctggcaaggcgcag

SEQ ID NO: 435180 - DNA, 551 bp, Homo sapiens
  misc_feature: GZ8MTXP02GBXLO.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgatctttctggatccactttgaagagtggagtcccagccaggttcagcggcagtggtctgggacactatttcactctcaccatcagcagcctgccagcctggagtactttcgcgtactttattactgacccaaacaattactttacttttttactccgttacttagttttggtacgtaggggtaccaagtcgtaggagaagtacgaaaaggtactggtaggctagacacactcgtcgttcttcacttccttcccgctactctagtactattactctacgtctgaacgtcggactcggacaacggcaga

SEQ ID NO: 435181 - DNA, 562 bp, Homo sapiens
  misc_feature: GZ8MTXP02HUOYV.44.75.G09.1.454.CMB.2.raw
  modified_base (351)..(351): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctgggacactatttcactctcaccatcagcagcctgcccagcctggagtntttcgcgtcttattactcgacctaaactaattatttccttttttaacttccgttaacgtacgtttttacggcccgtaagggggtaacccaaaggcttgggagatacgaaaagggaacttggtggtctaggaccacctatcgtcgttcttcattccttcccgcactctgacttatactactcgtctgaacgcggcgtggcgaacggcacgag

SEQ ID NO: 435182 - DNA, 663 bp, Homo sapiens
  misc_feature: GZ8MTXP02G7MMB.44.75.G09.1.454.CMB.2.raw
tcagacagtatatacacgaccggtgctcgatttagtatagacatcagggacttaggggctttgccaggctcctgctgctctgtttccccggtgccagatgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcgcagtggtctgggacacatttcactctcaccatcagcagcctgcagctggagtatttcgcgtacttattactcgacctaaacaatttacttactttttatacccgttactaggttttcgggacccgtaggggtaacccctaaggtccgttagggaacgtaacttacgaaaacgggtaaaccgttagggttgggaccgttaggaccaacccgtaagttaccttcgttccgtttacctaactttcccgtttcccccggtaccctaaacttcccgttacggtaactttaacgttactttaaaccgttcggttaccttaaggggaaccggtcccgggggtacgttcggggtacccgtaaaacggggtccggtaaaccg

SEQ ID NO: 435183 - DNA, 524 bp, Homo sapiens
  misc_feature: GZ8MTXP02F95AQ.44.75.G09.1.454.CMB.2.raw
  modified_base (251)..(251): a, c, t, g, unknown or other
  modified_base (349)..(349): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtccccagccaggttcagcggcagtggttctggggacacatttcactctcaccatcagcagcctgcccagcctgganatttcgcgtacttattactgacccaaactaattattctttttatccgttactagttttggcctaggggaccaagctggagatacgaaaaggaactggtaggctgcaccatctgtcttcatccttcccgcctatctagactatatactgtctgaagtcggctggcgaaggcgctaa

SEQ ID NO: 435184 - DNA, 712 bp, Homo sapiens
  misc_feature: GZ8MTXP02GYV8W.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgtacttcttttctggactcctactttgaagagtggagtcccagccaggtcagcggcagtggtctgggacactattcactctcaccatcagcacgcctagcccacgtcccgtgggacgtacgtttccggactactttattacctcgaaccctaaactaattactttacttttttaactccgttacgttaggttttacgggacccgtaacgggggtaacctaaggtaccgtagggaacggtaactaacgtaaaaacggggtaaccgttaggtacgggtccgttacggaccctaacccgtaactttacccgttacggtttcctttacccttaacctttccccggttttaaccccccgtacccttaacgtttacgttaagttaactttaaacgttaacgtttaccgttacggttacggttacggtaaccgggtcgggtaccggtacgggacggtaacgggtacgtaacgtag

SEQ ID NO: 435185 - DNA, 538 bp, Homo sapiens
  misc_feature: GZ8MTXP02J1LYT.44.75.G09.1.454.CMB.2.raw
tcagacagtatatacacgaccggtgctcgatttagtatagacatcgggggtctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgcggccccaggacagagcgtcgccatctcctgctctggaaacaactccaacattggtcgtaatcatgttacatggtaccaaaaagtcgctggctcggcccctaaagtcctcatttatgagaatcttagacggcccacctggactctctgaccgattctctgcctctaagtctggaactttcagccactttggccctatccaccggactccagactggagacgaggcccgattactattgtgggcttgggacttcagtccttggtggtggggtttcgcggtagggacccgacgtcgaccgtccgtaacgtccaacgccccaagggcctcgccccctcggtccacgttccg

SEQ ID NO: 435186 - DNA, 689 bp, Homo sapiens
  misc_feature: GZ8MTXP02G43RU.44.75.G09.1.454.CMB.2.raw
  modified_base (306)..(306): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgtacttcttttctggatcctactttgaagagtggagtcccagccaggtcagcggcagtgtcngggacactattcactctcaccatcagcagcctgccagcctaggagtatttcgacgtacttattactacgacctaaactaattactttactttttactacccgttaacttaggttttacggacccgtaaacgggggtaacctaacggtaccgtagggtaaagtacgttaacgaaaaagggtaaccgtagggttacgggtacgttacggaccctaaacccgtaactttccgttacggtttacctttaccgttaaccgtttacccctttccccggtacccttaacttacccggttagttaaacctttaattaacttaacgtttcgttaaccgtggggttaacgggccggggttcgtacggggaccgaaacgggtccgacgtaaagg

SEQ ID NO: 435187 - DNA, 610 bp, Homo sapiens
  misc_feature: GZ8MTXP02H8FKI.44.75.G09.1.454.CMB.2.raw
  modified_base (274)..(274): a, c, t, g, unknown or other
  modified_base (353)..(353): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggcctggtttcagcaggagcctggcaaacgcccctaagtccctgtatctttttctggactcctactttgaagngtggacgtcccagccagtcagcggcagtggttctgggacacatttcactctcacatcagcagcctgccagcctggagtntttcgcgtactttattactacgacctaaataactttatttctttttactccgtacttagttttcggaccgaggggtacctaaggtcgtagggacgtagtaacgaaaaggtacgttggtacggtactggacctacctattaccgttcgttccttactactttcccttccccgacctaacttccttgtaacttaattacttacgttcgttcgtacggtaacggtccggggtacgtacgggaccgaacggtccgacgtag

SEQ ID NO: 435188 - DNA, 525 bp, Homo sapiens
  misc_feature: GZ8MTXP02GKNZ8.44.75.G09.1.454.CMB.2.raw
  modified_base (251)..(251): a, c, t, g, unknown or other
  modified_base (304)..(304): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattctttcnggactccactttgaagagtggagtccccagccaggttcagcggcagtggttcnggggacactatttcactctcaccatcagcagcctgccagcctggagatttcgcgtctttattactgaccaaactaattattctttttatccgttactagtttggccgaggggaccaagctaggagatacgaaaggactaggtggctgacacatctgtctctatcttcccgctactctgtactatactactcgtactgaagcggcgtcggacacggcgacag

SEQ ID NO: 435189 - DNA, 511 bp, Homo sapiens
  misc_feature: GZ8MTXP02F3YA4.44.75.G09.1.454.CMB.2.raw
  modified_base (251)..(251): a, c, t, g, unknown or other
  modified_base (302)..(302): a, c, t, g, unknown or other
  modified_base (425)..(425): a, c, t, g, unknown or other
  modified_base (509)..(509): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtccccagccaggttcagcggcagtggtcngggacacatttcactctcaccatcagcagcctgccagcctggagtatttcgcgtactttataactgacccaaactaattattctttttatccgttactagtttggccaggggaccagctgganatcaaaaggactgtggctgacacatctgtcttcactcttcccgctactctgatatactactgtctgaagcggcgtgcgagcganag

SEQ ID NO: 435190 - DNA, 549 bp, Homo sapiens
  misc_feature: GZ8MTXP02GR3XO.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagcccaggttcagcggcagtggttctgggacacatttcactctcaccatcagcagcctgccagcctggatatttcgcgtacttattactgaccaaactaattatttcttttttaactccgttacttagttttcggaccgtagggggaacccaagtcgtaggaagtatacgaaaaggtactggtggctcgacaccactcgtagttcttctacttccttcccgactactctagtactatactactcgtctgaagcggctcggacaggcacgag

SEQ ID NO: 435191 - DNA, 515 bp, Homo sapiens
  misc_feature: GZ8MTXP02F9F3K.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtccccagccaggttcagcggcagtggttctgggacacatttcactctcaccatcagcagcctgccagcctggatatttcgcgtaccttattactgccaaacaattattctttttatccgttactagttttggccaggggacccaagctaggagatcaaaggactgtaggctgcacatctgtcttcatccttccgctactctagatatatactgtctgaagtcggcgtggacaacggcgcag

SEQ ID NO: 435192 - DNA, 511 bp, Homo sapiens
  misc_feature: GZ8MTXP02GKWAW.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggtctgggacacatttcactctcaccatcagcagcctgcccagcccggagactttcgcgtacttattactgaccaaactaatattcttttttatccgttactagttttggccgtaggggaccaagctggagatacaaagaactgtagctgcacatctgtctcactctcccgcatctgatactatactgtctgagcggctacggcaaggcgacatag

SEQ ID NO: 435193 - DNA, 554 bp, Homo sapiens
  misc_feature: GZ8MTXP02HTK4F.44.75.G09.1.454.CMB.2.raw
  modified_base (251)..(251): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatcccactttgaagagtggagtcccagccaggttcagcggcagtggttctggggacacatttcactctcaccatcagcagcctgccagcctggagtatttccgcgtactttattactcgaccctaaactaattactttccttttttacttacccgttaacttagtttttcggacccgtaagggggaccctaaggcgttagggagatacgaaaaggactaggtggctgacaccatctgtcttcattcctcccgctactctgactattatactgtactgaacgcggctggacacggcgactag

SEQ ID NO: 435194 - DNA, 516 bp, Homo sapiens
  misc_feature: GZ8MTXP02JRI73.44.75.G09.1.454.CMB.2.raw
  modified_base (185)..(185): a, c, t, g, unknown or other
  modified_base (251)..(251): a, c, t, g, unknown or other
  modified_base (364)..(364): a, c, t, g, unknown or other
  modified_base (419)..(419): a, c, t, g, unknown or other
  modified_base (433)..(433): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccganattaggacttttttggcctggtttcagcaggagcctggcaaagcccctaagtccctgattctttcnggatccactttgaagagtggagtccccagccaggttcagcggcagtggtctgggacacattcactctcaccatcagcagcctgccagcctggatatttcgcgtacttattacngaccaaactaattattcttttatccgtatagtttgccaggggaccagcgtagganatacaaaggactgnggctgccacatcttgtcttcacttccttcccgcctatctagactatactactgtctagaagcgggactcggcaaggcgacaag

SEQ ID NO: 435195 - DNA, 515 bp, Homo sapiens
  misc_feature: GZ8MTXP02GXULT.44.75.G09.1.454.CMB.2.raw
  modified_base (349)..(349): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctggggacacatttcactctcacccatcagcagcctgcccagcctggganatttcgcgactttattactgaccaacaattattctttttatccgttactagtttggccaggggaccaagctggagatcaaaggactagtggctgcacatctgtcttcacttcctcccgccatctgtactatattactgtctgaacgcgggctcggcaaggcgacag

SEQ ID NO: 435196 - DNA, 504 bp, Homo sapiens
  misc_feature: GZ8MTXP02GAYVV.44.75.G09.1.454.CMB.2.raw
  modified_base (344)..(344): a, c, t, g, unknown or other
  modified_base (384)..(384): a, c, t, g, unknown or other
  modified_base (470)..(470): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcacatcagcagcctgccagcctgganatttcgcgtcttattactgccaaacaatattcttttttanccgttactagttttggccagggggaccaagctggagatcaaaggaactgtaggctgcaccatctgtcttcatccttccgcactctnatatatactgtctgaagtcggctggcaaggcaca

SEQ ID NO: 435197 - DNA, 515 bp, Homo sapiens
  misc_feature: GZ8MTXP02FN2IY.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgccagcctggatatttcgcgtacttattactgaccaaactaattattctttttatccgttactagtttggcgaggggtaccaagctggagatacaaaggactgtaggctgcacatctgtcttcatcctcccgctactctagtatactatactcgtctgaagcggctggacgacggcgtacag

SEQ ID NO: 435198 - DNA, 696 bp, Homo sapiens
  misc_feature: GZ8MTXP02HWLCN.44.75.G09.1.454.CMB.2.raw
  modified_base (255)..(255): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggccttggtttcagcaggagcctggcaaacgcccctaagtccctgattcttttcnggatccactttgaagagtggagtcccagccaggttcagcggcagtggtctgggacactatttcactctcaccatcagcagcctgccagcctggatatttcgcgtactttatactgaccctaaataattatttctttttactaccgttaacttaaggttttcggacccgtaagggggtaaccctaaaggtccgttaggggaacgtaagttaaccgaaaaagggttaaaccgttgggttacggggtccttacgggacctaaccccgtaagttaccttacggtttaccctttccgttaaccgtttacccctttacccccggacccctttacttacccgtttaggtaaactttaaactttaaacttaaccttaggttaccgtttggaaacggggtcccgggggtcgttacgggggaccgtaaaacgggggtcccgtaaacgtaag

SEQ ID NO: 435199 - DNA, 545 bp, Homo sapiens
  misc_feature: GZ8MTXP02ISFVF.44.75.G09.1.454.CMB.2.raw
  modified_base (251)..(251): a, c, t, g, unknown or other
  modified_base (267)..(267): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagngtggagtcccagccaggttcagcggcagtggttctggggacactatttcactctcacccatcagcagcctgcccagcctggagtatttccgcgtactttattactgaccctaacaatattctttttatccgttactagttttcggccgagggggacctaaggcgtgggaagatacgaaaagggtaacttggtaggtctgccaacctatcctgtcttcactccttcccgcctactctgactatacttactgtctgaagtcggctcggacgaggcgacag

SEQ ID NO: 435200 - DNA, 515 bp, Homo sapiens
  misc_feature: GZ8MTXP02FVSMH.44.75.G09.1.454.CMB.2.raw
  modified_base (251)..(251): a, c, t, g, unknown or other
  modified_base (513)..(513): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggtcagcgcagtggtctgggacacattcactctcaccatcagcagcctgccagcctggatatttcgcgtacttattactgacccaactaattatttctttttatccgttactagttttcggccgtaggggaccaagctaggagagtacgaaaggactgtggctgacacatctgtcttcatcctcccgctactctagtactatactactgtctgaagcgggctggcaggcanag

SEQ ID NO: 435201 - DNA, 527 bp, Homo sapiens
  misc_feature: GZ8MTXP02ING3U.44.75.G09.1.454.CMB.2.raw
  modified_base (252)..(252): a, c, t, g, unknown or other
  modified_base (302)..(302): a, c, t, g, unknown or other
  modified_base (346)..(346): a, c, t, g, unknown or other
  modified_base (526)..(526): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggatccactttgaagagtggagtcccagccaggttcagcgcagtggttcngggacacatttcactctcaccatcagcagcctgccagcctggantttcgcgtactttatactgacccaaacaattactttactttttatccgttactagttttcggcctagggggacctaagctaggaagatacgaaaagggtaactggtcgctgcaccatctgtcttcacttctacccgctactctgactatatactgtctgaagcggctcggacacggcgana

SEQ ID NO: 435202 - DNA, 658 bp, Homo sapiens
  misc_feature: GZ8MTXP02HROOP.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacctagtctccgtcctcactgtctgcgtctattggggacagagtcaccatcacttgccgggcgagtgccgacattaggtactttttttggccttggtttcagcaggagcctggcaaacgcccctaagtccctgattcttttctggatccactttgaagagtggagtccccagccaggttcagcggcagtggttctgggacactatttcactctcaccatcagcagcctgccagcctggatatttccgcgtactttattactgaccctaaacaaatttactttccttttttactacccgttacttacggtttttcgggacccgtaagggggtaacccaaggtcgttagggaagtacgtaacgaaaagggtaaccgttaggttcgggtacttacggacctaacccgtaattccgttacgttcctttactaacctttcccttcccccgtcctaacgttccttaggtaaactttaattaacgttaccttcgttaccgttagggaacggtcggggtacgttcggggaccgtaaacggggccgtaactaag

SEQ ID NO: 435203 - DNA, 515 bp, Homo sapiens
  misc_feature: GZ8MTXP02IO5QU.44.75.G09.1.454.CMB.2.raw
  modified_base (251)..(251): a, c, t, g, unknown or other
  modified_base (301)..(301): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggatcccagccaggttcagcggcagtggttcngggacacatttcactctcaccatcagcagcctgccagcctggagtatttccgcgtactttatactgaccaaactaattattctttttatccgttactagtttggccgtaaggggtaccaagctggagatacaaaggaactggtaggctgcaccatctgtcttcattcctcccgcctatctgatatatactgtctgaagcggctggcagcgacta

SEQ ID NO: 435204 - DNA, 500 bp, Homo sapiens
  misc_feature: GZ8MTXP02IF1HB.44.75.G09.1.454.CMB.2.raw
  modified_base (251)..(251): a, c, t, g, unknown or other
  modified_base (267)..(267): a, c, t, g, unknown or other
  modified_base (341)..(341): a, c, t, g, unknown or other
  modified_base (498)..(498): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagngtgagtcccagccaggtcagcgcagtggtctgggacacatttcactctcacatcagcagcctgccagcctgganatttcgcgactttattactgaccaactaatatttctttttatccgtactagtttcgcgagggaccaagctggagatacaaaaggactgtaggctgacaccatctgtctcatctccgctatctgatatatactgtctgaagcggctggacacggcganag

SEQ ID NO: 435205 - DNA, 691 bp, Homo sapiens
  misc_feature: GZ8MTXP02JYON3.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctggggacacgtatttcactctcaccatcagcagcctgcccagcctggagtactttcgcgtacctttattacctagaccctaataaactttactttctttttaactccgttaacttacgttttcgggaccgtaacgggggtaaccctaaacggccgttagggaagtacgttacggaaaaacgggtaaacccgttgggtacgggtccttacgggtacccgaaacccgtacgtttaccttacggtttacccttttcctaaccgttttacccctcccccgtaaccttcctttacccggttacgtaaactttaaacttaacttaaccgttacggttccgttagggaacggttaccgggggccgttacgggacgtaaacggggtcggaccgtaacg

SEQ ID NO: 435206 - DNA, 540 bp, Homo sapiens
  misc_feature: GZ8MTXP02HBQGQ.44.75.G09.1.454.CMB.2.raw
  modified_base (346)..(346): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggtctgggacacatttcactctcaccatcagcagcctgccagcctggganatttcgcgactttacttactgaccaactaattacttcttttttactccgttacctagttttcggaccgtaggggaccaaagcttagggacgatacgaaaaggtactgtaggctgacaccatctgtcttcatccttcccgctactctcgtatactacttactgtctgaagtcgggcgtcggcgaaggccgacaag

SEQ ID NO: 435207 - DNA, 564 bp, Homo sapiens
  misc_feature: GZ8MTXP02H8WLH.44.75.G09.1.454.CMB.2.raw
  modified_base (506)..(506): a, c, t, g, unknown or other
  modified_base (515)..(515): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgtatctttttctggatccactttgaagagtggagtcccagccaggtcagcggcagtggtctgggacacatttcactctcaccatcagcagcctgccagcctggacgtatttcgcgtctttattactgaccctaaataattatttcttttttaactccgttactaggtttttcggaccgaacgggggtacctaaagcgtaggaagtatacgaaaaggaacttggtcggtctggacctacatcctgttcttctacttccttaccccnctactcctntaacttatattactgttctaggaacggcgggctggaccgaaggcgacag

SEQ ID NO: 435208 - DNA, 648 bp, Homo sapiens
  misc_feature: GZ8MTXP02JDOTG.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatctttctggatccactttgaagagtggatcccagccaggttcagcggcagtggttctgggacacatttcactctcaccatcagcagcctgccagcctggagtatttcgcgtacttattactgaccaataattatttcctttttactccgttacgttagttttcggaccgtaagggggaccaacggtcgtagggaagtacgtaacgtaaaagggtaaacgttaggtacgggcgttacggacctaaccgtacttaccgttacggttcctttaccgttaaccttccctttcccccggtacccttacgtttacccttaggtaaactttaacttaacgttacctttacggttccgttacgggaacggggtccggggtacgttcggggaccgtaaacgggtccggacgtaag

SEQ ID NO: 435209 - DNA, 635 bp, Homo sapiens
  misc_feature: GZ8MTXP02G9IQV.44.75.G09.1.454.CMB.2.raw
  modified_base (250)..(250): a, c, t, g, unknown or other
  modified_base (298)..(298): a, c, t, g, unknown or other
  modified_base (315)..(315): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggactccactttgagagtggatcccagccaggtcagcgcagtggttcngggacacatttcactcncaccatcagcagcctgccagcctggactatttccggcgtactttattactcgacctaactaattacttctttttactccgttacttaaggttttcggaccgtaagggggtacccaaggtctagggtagtaactacgaaaagggtaacttggtacggtacgttacggacctaacccgtacttacgttcggtttcctttacctaaccgtttcccgttcccccgtacctacttccgttagtactttaaacttacttaaccgttcgttccgttaggaacgggtccggggtccgttaggggaccgtaaacggtcggtaccgtaag

SEQ ID NO: 435210 - DNA, 516 bp, Homo sapiens
  misc_feature: GZ8MTXP02G3W1V.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctggggacacatttcactctcacccatcagcagcctgccagcctggagatttcgcgactttatactgaccaacaattattctttttactccgttactagttttggcctagggggaccaagctaggagatcaaaaggactgtggctgacaccatctgtcttcatccttcccgcctatctgactatactactgtctgaagtcggctggcaggcgata

SEQ ID NO: 435211 - DNA, 526 bp, Homo sapiens
  misc_feature: GZ8MTXP02I4Q5R.44.75.G09.1.454.CMB.2.raw
  modified_base (254)..(254): a, c, t, g, unknown or other
  modified_base (305)..(305): a, c, t, g, unknown or other
  modified_base (434)..(434): a, c, t, g, unknown or other
  modified_base (449)..(449): a, c, t, g, unknown or other
  modified_base (452)..(452): a, c, t, g, unknown or other
  modified_base (454)..(454): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttcnggatccactttgaagagtggagtcccagccaggttcagcggcagtggttcngggacacatttcactctcaccatcagcagcctgccacgccgtggatatttccgcgtacctttattactgacccaactaattatttctttttatccgttactagtttggacctaggggactagcgtgganagtacaaaggactgnggntncgaccatctgtctcactcctccgctactctgtatacttatactgtctgaagcggcgtcggacacggcgctag

SEQ ID NO: 435212 - DNA, 586 bp, Homo sapiens
  misc_feature: GZ8MTXP02H56ZJ.44.75.G09.1.454.CMB.2.raw
  modified_base (366)..(366): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggatcccagccaggttcagcggcagtggttctgggacacatttcactctcaccatcagcagcctgcccagcctggagtatttcgcgtacttattacngacccaaactaatatttctttttatccgtactgtttcggccgtaggggaccaagcgtaggagactacgaaaaggaactggtcggtactacggaccaccaacttcgtcgtctttactacttcccgttccccgaccctattccgttagtaacttaacttacttaaccgttgttccgttaggaacggtccggggtcgtacgggacgaacgggtcgaacggtag

SEQ ID NO: 435213 - DNA, 620 bp, Homo sapiens
  misc_feature: GZ8MTXP02JNT2N.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagcccaggttcagcggcagtggttctgggacacatttcactctcaccatcagcagcctgccagcctggagtatttcgcgtactttattactcgaccaaataattacttctttttttaatcccgtttaactacgtttttggacccgtaagggggacccaaaggccgtagggaagtagttaccgaaaagggtaaccttggtcgggtctgggacccaacctacgtttctacgttcctttcctaacttccctttcccccggcccctaattccttagaacttattaacttaacctgttacccgttggaacggcggggtaccgttgggaccgaaacggggcgacgtag

SEQ ID NO: 435214 - DNA, 519 bp, Homo sapiens
  misc_feature: GZ8MTXP02IN8HV.44.75.G09.1.454.CMB.2.raw
  modified_base (517)..(517): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctggggacacatttcactctcaccatcagcagcctgccagcctggatatttcgcgtactttattactgaccaaactaatatttctttttatccgtatagtttggccgtaaggggacctaagctagggagatacgaaaaggaacttgtggctgcaccatctgtcttcatccttccgcctatctgtatatactactcgtctgaagcggctggcgagcgnta

SEQ ID NO: 435215 - DNA, 661 bp, Homo sapiens
  misc_feature: GZ8MTXP02HRFJM.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctattggggacagagtcaccatcacttgccgggcgagtgccgacattaggtactttttttggccttggtttcagcaggagcctggacaaacgcccctaagtccctgtacttcttttctggactcctactttgaagagtggagtcccagccaggttcagcggcagtgtctgggacacatttcactctcacatcagcagcctgccacgcctgagtactttccgcgtactttacttactgaccctaaataatttatttcctttttaactccgttaacgttagttttcggacccggtaacgggggtaaccaacggtcgttagggaagtacgtaaccgaaaagggtaaaccgttggtcggtaccgttcggacctaaccctaacgttaccgttcgtttcctttacctaactttccctttaccccgtcccttaaacgttccctagtaaactttaaagttacgttaacttcggtaccttgggtaacggcggggtcgttaacgggcgtaaacgggtccggactaacgg

SEQ ID NO: 435216 - DNA, 705 bp, Homo sapiens
  misc_feature: GZ8MTXP02GVZBE.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgattctttctggatccactttgaagagtggatcccagccaggttcagcggcagtggttctgggacactatttcactctcaccatcagcagcctgccagcctggagtactttcgcgtactttatactcgaccaaactaatttactttacctttttaactaccgttaacgttacggttttacggaccgtaacgggggtaacccaaagggtccgttagggaacgtaacgtaaccgtaaaaaggggaccgttagggtacgggtaccgtacggaccctaaacccgtaacttaccgttacggttccgtttaccgtaacctttaccccgtttcccccgtaccttaaaccgtttcccttaacggttaaactttaaacgttaaactttaaccgttacggtttcccgttaggaaccgggttaccgggggtcgttacgggggaaccgtaaaacgggcccggttaacgtaacgg

SEQ ID NO: 435217 - DNA, 629 bp, Homo sapiens
  misc_feature: GZ8MTXP02H3I47.44.75.G09.1.454.CMB.2.raw
  modified_base (260)..(260): a, c, t, g, unknown or other
  modified_base (310)..(310): a, c, t, g, unknown or other
  modified_base (319)..(319): a, c, t, g, unknown or other
  modified_base (589)..(589): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggccttggtttcaggcaggagcctggacaaacgcccctaagtccctgtacttcttttcnggtatcctactttagaagagtggactccagccaggtcagcgcagtggtcngggacactntttcactctcaccatcagcagctgccagccgtaggagtctttcgacgtactttactactacgacctaaactattacttttactttttacgcccgttaacgttagtttacgggacccggtaaggggtaaccgtaacggcgtaagggaagtagtaacgtaaaagggtacctggtacggtctacgactaacctacgttcctacgtttcctacttacctttcctcccccgtacttactaccgttagtacttaactactttaccgtgttaccggnggtaacgggtcgggtacgtacggaacgacggtacgactag

SEQ ID NO: 435218 - DNA, 746 bp, Homo sapiens
  misc_feature: GZ8MTXP02IQBFR.44.75.G09.1.454.CMB.2.raw
tcagacagtatatacacgaccggtgctcgatttagtatagacatcaggggtctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgccggccccaggacagagcgtcgccatctcctgctctaggaaacactccaacattggtacgtaatcatgtacatagtaacaaaagtcgctggctcggacccctaaagtcctactatttagtgtaagtaattcttacgaccgtccctacgtcggactcctcgtcgaccgtacttactcgtcgtacccttacgtaagtcctacgggtaaacttccaacgtccctaaacgtttcgggaccctaagtacccgacccgggtaaccttcccgaacggtaaccgttacgggacgaaaccgggtaacgggtaccccggttaaattttaaccgtaagttttcggggttacggggttaccgtttgggggtaaacccttccggtaacggttcccggtttgggggttcggggtttcggggggtttttaccggggccgggggtaaccgggggtaaccccgtacggtttaccgggtacccggttacccgttaacggtaccgaacccggtaccccggtaaacgggtcccgttacccggtacccccccggttacggtttcccggttaaccccg

SEQ ID NO: 435219 - DNA, 563 bp, Homo sapiens
  misc_feature: GZ8MTXP02IGRG6.44.75.G09.1.454.CMB.2.raw
  modified_base (254)..(254): a, c, t, g, unknown or other
  modified_base (561)..(561): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacatttaggtacttttttggcctggtttcagcaggagcctggcaaacgcccctaagtccctgatcttttcnggatccactttgaagagtggacgtccagccaggtcagcggcagtggtctgggacacatttcactctcacatcagcagcctgccagcctggagtatttcgcgtactttattactgaccctaactatactttactttttatccgtattacgtttcggccgtaggggtaccaagtcgtaggagagtacgaaaggtactggtcggtactcgactaccatcttacgttcttctaccttctccccgactactctacgtactattactacgtcgttacgtaggaacggtcggtacgtcggaccgaggtaccganag

SEQ ID NO: 435220 - DNA, 527 bp, Homo sapiens
  misc_feature: GZ8MTXP02I0GD2.44.75.G09.1.454.CMB.2.raw
  modified_base (250)..(250): a, c, t, g, unknown or other
  modified_base (264)..(264): a, c, t, g, unknown or other
  modified_base (299)..(299): a, c, t, g, unknown or other
  modified_base (505)..(505): a, c, t, g, unknown or other
  modified_base (511)..(511): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcngatccatttgaagngtggagtcccagccaggttcagcggcagtggttcngggacactatttcactctcacctatcagcagcctgccagcctggatatttcgcgtctttattactgacccaataattatttctttttatccgttactagtttcggccgtaggggacccaagcgtaggagatacgaaaggtactgtaggtctgcaccgtatctgtcttcacttcctcccgctactctgtactattactactgtctgngcggtntcggacgaggcgatag

SEQ ID NO: 435221 - DNA, 678 bp, Homo sapiens
  misc_feature: GZ8MTXP02F4MIU.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttctggactccactttgagagtggagtcccagccaggttcagcggcagtggttctgggacactatttcactctcaccatcagcagcctgccagcctggagtatttcgacgtacttactactgacctaactaatttactttctttttaactccgttacgttagttttcggacccgtaacgggggaccctaaaggtcgtagggaagtacgtaacgtaaaagggtaaaccgttggtacgggtcgttacggaccgtaaaccgtaacgttcctttacgtttccctttacctaaccgtttaccccgtttcccccgtacccttaaccgtttaccgttacgttaaactttaacgtttaactttaaccgtttaggttccgtttaggggaacgggtccgggggtcgttacggggaccgtaaacggggtccgtaacgtaag

SEQ ID NO: 435222 - DNA, 542 bp, Homo sapiens
  misc_feature: GZ8MTXP02GZI18.44.75.G09.1.454.CMB.2.raw
  modified_base (267)..(267): a, c, t, g, unknown or other
  modified_base (378)..(378): a, c, t, g, unknown or other
  modified_base (540)..(540): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagngtggagtcccagccaggttcagcggcagtggtctgggacactatttcactctctaccatcagcagcctgccagcctggagtactttcgcgtacttattactgaccctaaanattattctttttactccgttatagtttaggccgaggggaccaaggtctagggagagtacgaaaaggtactaggtcggtacgtgaccacctactctgttcttcacttccttcccgcctatctagactatactactgtactgaagtcggctcgggacaggccgnta

SEQ ID NO: 435223 - DNA, 786 bp, Homo sapiens
  misc_feature: GZ8MTXP02ILU73.44.75.G09.1.454.CMB.2.raw
tcagacagtatatacacgaccggtgctcgatttagtatagacatcaggggtctgcttcagctgtgagcgcagaaggcaggactcgggacaatcttcatcatgacctgcctcccctctcctcctcacccttctcattcactgcgcagggtcctgggcccagtctgcattgacgcagcccgccctcagtgtctgccggccccaggacagagcgtcgccatctcctgctctaggaaacactaccaacattggtacgtaatctatgttacatacggtaaccaaaagtcgacgtcggctccggacccctaaagtccctactatttatagagtaacttcgttacgaccgtaccccacgtcgtactcctcgtacgaccgttacttctcgtcgtccttactaaacgtccgttacggtaaacctttcgacgtccctaccgtttcggaccctaagttacccgaccggtaccttacccgaacggtacccgttagggaacggaaaccggtaaccgggtacccggttaaactttttaaccgttaacggttttacgggggtttaccggggtccggtttacgggggtacccctttaccgggaaccggtttcccgggtttagggggtttacgggggtttcggggggtttttaccggggaccgggggtttaaacccgggggacccccgttaacggttaccggggtaaccccgtttaacccggtaaacggttcccgaaaccggccccggtaaacgggtccccgtacccggtcccccccggtttaacgggtcccgtttaaccccg

SEQ ID NO: 435224 - DNA, 526 bp, Homo sapiens
  misc_feature: GZ8MTXP02H3AH5.44.75.G09.1.454.CMB.2.raw
  modified_base (253)..(253): a, c, t, g, unknown or other
  modified_base (345)..(345): a, c, t, g, unknown or other
  modified_base (373)..(373): a, c, t, g, unknown or other
  modified_base (426)..(426): a, c, t, g, unknown or other
  modified_base (511)..(511): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgtatcttttcnggatccactttgaagagtgagtcccagccaggtcagcgcagtggtctgggacacatttcactctcaccatcagcagcctgccagcctggatntttcgcgtctttattactgaccctaaanattatttcctttttactccgtacttgtttcgccgtaggggaccaagctagganatacgaaaggactggtaggctcgacaccctatctagttctctacttcctcccgccactctagtatatactactgtctgaagcggntcggcacggcgacag

SEQ ID NO: 435225 - DNA, 641 bp, Homo sapiens
  misc_feature: GZ8MTXP02ILB7Z.44.75.G09.1.454.CMB.2.raw
  modified_base (295)..(295): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgatcttttctggactcctactttgaagagtggacgtccagccaggtcagcgnagtgtctgggacactatttcactctcaccatcagcagcctgccacgcctggtacgtatttccgcgtactttattactcgaccctaaactaattacttttactttttactccgttacgttagtttcggaccgtaacggggtacctaaggtcgtaggaagtacgtaacgaaaacgggtaaccttggtacggtacgttacggacctaaacccgtagttccgttacgtttccgtttacctaacctttccctccccggtaccttacttacgttacgtaacttaattaacttacgttacgttacgtacggtaacggtcggtacgttacgggaacgtacggacggtactaagg

SEQ ID NO: 435226 - DNA, 718 bp, Homo sapiens
  misc_feature: GZ8MTXP02HQ9LY.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggccttggtttcagcaggagcctggcaaacgcccctaagtccctgattcttttctggactccactttgaagagtggagtcccagccaggttcagcggcagtggttctggggacacatttcactctcacatcagcagcctgcccagccgtggagtatttccgcgtactttaagttactcgaccctaaactaaatttactttacctttttttactacccgtttaacgttaggttttttacgggacccggtaacgggggtaacccctaaaggtccgttaggggaacgtaacgttaacgaaaacgggtaaccgttagggttcgggtacttggacctacccctaattcccgttcggttcctttaccgtaactttaccccgttttccccccgggacccttaacgtttcccgttacgtaaactttaaagtttaacgttaacccttcggtttacccgtggttaaccgggggccgggggtaccgttcgggggtaccgtaaaacgggggtcccgtaacccgtaaacgg

SEQ ID NO: 435227 - DNA, 603 bp, Homo sapiens
  misc_feature: GZ8MTXP02JDOJP.44.75.G09.1.454.CMB.2.raw
  modified_base (293)..(293): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggnagtggttctggggacacgatttcactctcaccatcagcagcctgccagcctgagtatttcgcgtactttattactgaccaaataattacttctttttactccgttacttagtttacggccgtaggggtaccaacggtctagggaagacgtacgaaaagggtaactggtacggtccttacggacctacccctaagttccttacggttctttaccactttcccgttaccccgtcctaacttcctagtacttatacttacgtcgttcgtacgaacggtccgggtacttacggggacaacggggtccacgtaag

SEQ ID NO: 435228 - DNA, 578 bp, Homo sapiens
  misc_feature: GZ8MTXP02G56WE.44.75.G09.1.454.CMB.2.raw
  modified_base (301)..(301): a, c, t, g, unknown or other
  modified_base (576)..(576): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggatccagccaggttcagcggcagtggttcngggacacgtatttcactctcaccatcagcagcctgcccagcctggagtatttcgcgtactttacttactgacctaaactaattactttacttttttactccgttacgttacggttttcgggtaccctaagggggtaccctaaaggtcctagggaacgtataccgaaaaggtaccgtaggtggtactcggaccaacctagtcgtacgttccttactacttcctcccgacctactctcgatactactactgtactgaagtcggcgtcggacaggcanag

SEQ ID NO: 435229 - DNA, 632 bp, Homo sapiens
  misc_feature: GZ8MTXP02H0CKB.44.75.G09.1.454.CMB.2.raw
tcagacagtatatacacgaccggtgctcgatttagtatagacatcaggggtctgcttcagctgtgagcgcagaaggcaggactcgggacaatcttcatcatgacctgcctccctctcctcctcacccttctcattcactgcgcagggtcctgggcccagtctgcattgacgcacgccgccctcagtgtctgccggccccaggacagagcgtcgccatctcctgctctagaaacactaccaacattgtactaatcatgttacagtacggtaaaccaaaagtcgctggcctaccggacccctaaagtcctactattatagataatcttaacgaccgcccactcggacttctctacgacgtattctctcgccttactagtcttcgaaactttcgaacgtcctactttcggacctacgtacccaccggtacctccgaacgtacgtacggacgaaaccggacggtaccgtaagtttacgtacgtttagggttacgggtgtttacgggaccttaccgacggttccgtttggggtcgggtttcggggtttcggacggggtacgggacccgtacgtcggtacccgtctaacggtccgaaccgtccgtaacgcccgtaccgtcccccgtcggtacctcccg

SEQ ID NO: 435230 - DNA, 566 bp, Homo sapiens
  misc_feature: GZ8MTXP02G2QNE.44.75.G09.1.454.CMB.2.raw
  modified_base (367)..(367): a, c, t, g, unknown or other
  modified_base (518)..(518): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctgggacacatttcactctcaccatcagcagcctgcccagcctggatatttcgcgtacttattacncgaccaaactaattattacttttttactccgttactagttttcggaccgtagggggaccaacggcttagggaagagttacaaaagggtaaccttaggtacgggtactggactaaccattctgttcttcacttccttccccgtctactcgtnactatactacctagtctgaacggcggcgtacggccgaaggccgtacag

SEQ ID NO: 435231 - DNA, 601 bp, Homo sapiens
  misc_feature: GZ8MTXP02H1M9Y.44.75.G09.1.454.CMB.2.raw
  modified_base (253)..(253): a, c, t, g, unknown or other
  modified_base (366)..(366): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggacaaagcccctaagtccctgatcttttcnggatcctacttgaagagtggacgtcccagccagtcagcgcagtgtctgggacacattcactctcaccatcagcagcctgccagcctggagtatttcggactactttattaacncgaccaaataatttactttactttttactaccgttacgttacgtttcggaccggacgggactaagtcgtaggaagtacgtaacgaaaaggtacgttaggtacggtacgtacgtaccacctacgtacgttcgttacttactaccttacccttacccgtacctactactacgtacttacttactacgtacgtacgtacggtaacggtcggtacggtacggacgacggacgacgtacg

SEQ ID NO: 435232 - DNA, 554 bp, Homo sapiens
  misc_feature: GZ8MTXP02FZM84.44.75.G09.1.454.CMB.2.raw
  modified_base (254)..(254): a, c, t, g, unknown or other
  modified_base (354)..(354): a, c, t, g, unknown or other
  modified_base (383)..(383): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtgccgacattaggtacttttttggcctggtttcagcaggagcctggacaaagcccctaagtccctgattctttcnggactccactttgaagtagtggacgtcccagccaggttcagcggctagtggttctgggacactatttcactctcaccatcagcagctgccagcctggatnttcgcgtacttatactgacccaataattntttacttttatccgttacttagtttcgacgaaggggaccagtcgtagagatacgaaaggtacgtaggtcggcgtcgacacctactcgttcttcttactactccgttcccgtctactctactattactattacgtgtcgtggtaacggtcggtcgtcggacgacggcgatag

SEQ ID NO: 435233 - DNA, 613 bp, Homo sapiens
  misc_feature: GZ8MTXP02G4N6M.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggactccactttgaagagtggagtcccagccaggtcagcggcagtggtctgggacactatttcactctcaccatcagcacgcctgcccagcctggacgtactttccgacgtctttattactcgacctaaactaattatttcctttttatccgttacttacggtttcggacccgtaagggggaacctaacgcgtagggaagtagtaacgtaaaaggtaacgttaggtacggtccgtaggaccctaacgtacttccgttacgttctttaccactttcccgttccgacccttagtccttgtaacttattattacgtttcgtacgtacggaacggtcggtcgttcgggacgaacggccgtacgtaag

SEQ ID NO: 435234 - DNA, 699 bp, Homo sapiens
  misc_feature: GZ8MTXP02G9N6Z.44.75.G09.1.454.CMB.2.raw
  modified_base (266)..(266): a, c, t, g, unknown or other
  modified_base (308)..(308): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagngtggagtcccagccaggttcagcggcagtggttcgtgggacnctatttcactctcacccatcagcagcctgcccagcctggagtagtttccgcgtactttacttactcgtaccctaaactaaatttactttaccttttttacttacccgtttacgttacgttttcgggacccgtaacgggggtaacccgtaaacggtcgtaggggtaacgtaacgtaacgaaaagggtaccttagggtcggtacgttcggaccgtaacccgtagtttcccttcggtttacctttacctaccgtttccccttcccccggtacccttaacttcccgttaagtaaactttaacttaaacctttaccgtttacggttcccgttaaggtaaccggggttccgggggaccgtttacgggggaaccgtaacgggggtacccgacggtaag

SEQ ID NO: 435235 - DNA, 589 bp, Homo sapiens
  misc_feature: GZ8MTXP02IDPBS.44.75.G09.1.454.CMB.2.raw
  modified_base (255)..(255): a, c, t, g, unknown or other
  modified_base (271)..(271): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggacaaacgcccctaagtccctgtatcttttcnggatcctactttgagngtggacgtccagccaggtcagcggcagtgttctgggacactatttcactctcaccatcagcagctgccagcctggagtatttcgcgtacttattactcgacctaactaattactttctttttaactaccgtacttagtttcggacccgtaaggggtaacccaaaggtccgtagggaagtacgtaacgaaaaggtaaccgttggtagggtctggaccctaactacgtcgttacttcttactacttcccttcccgtcctatcttatactactactacgtacgtacgtacgtaacggcggcgtcggacgacggacgacgag

SEQ ID NO: 435236 - DNA, 722 bp, Homo sapiens
  misc_feature: GZ8MTXP02H3AT1.44.75.G09.1.454.CMB.2.raw
  modified_base (253)..(253): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgtatcttttcnggatccactttgaagagtggatcccagccaggttcagcggcagtggttctgggacacatttccactctcaccatcagcagcctgccagcctggactatttccgcgtactttacgtttaactcgaccctaaactaatttacttttaccttttttaactccgttaacgttaggtttttcgggacccgtaacgggggtaaccctaaacggtaccgttagggaagtaacgtaacgtaaaaacgggtaaaccgtggttacgggtccgtacggtaccctaacccgaactttccgttacggtttcctttccgtaactttcccgtttaaccccccggtccccttaaactttcccgttaacgttaattttaaacgttaaactttaaccgttacggttttcccgttaacggggtaaggggttacccgggggacggtttccgggggaaccgttaaacgggggtccccgtacggtaaaacg

SEQ ID NO: 435237 - DNA, 643 bp, Homo sapiens
  misc_feature: GZ8MTXP02FLTC6.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctggggacacatttcactctcacccatcagcagcctgccagcctggagatttcgcgtacttattactcgaccaactaattactttactttttactaccgttacttaggttttcggccgtaacggggtaaccacggtcgtagggaagtaagtaacgtaaaaggggtaaacgttgggtacgggccgttacgacctaacctacgttaccttcggttcctttaccttaacttccctttcccccgaccttacgttacccttagttaactttaaacttaactttaaccgttacggttaccgtggtaacgggaccggggtcgttacggggacgtaaacgggcggactaacg

SEQ ID NO: 435238 - DNA, 663 bp, Homo sapiens
  misc_feature: GZ8MTXP02HX53D.44.75.G09.1.454.CMB.2.raw
  modified_base (251)..(251): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgccagcctggatatttccgcgtactttattactgaccctaaactaattatttacttttttaatccgttactagtttggccgtaagggggtacctaaggcgtagggacgatacgaaaagggtaaccgttaggtacgggtacttacggacctaacccgtaacgttccttacggtttcctttaccgtaacttaccctttcccccgtacccttaactccctttaggtaaacctttaagttaaactttaacctttcggttacccgttagggaaccgggtcgggggtaaccggtttcgggggtaccgtaaaacggggtccggtaaccgtaaacgg

SEQ ID NO: 435239 - DNA, 559 bp, Homo sapiens
  misc_feature: GZ8MTXP02GBLN5.44.75.G09.1.454.CMB.2.raw
  modified_base (487)..(487): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggtctgggacacatttcactctcaccatcagcagcctgccagcctggactatttcgcgtacttatactgacccaaactaattactttactttttatcccgttaactagttttcggaccgtaagggggaccctaaagtcgtagggaagactacgaaaagggtaacctaggttggactcgaccaacctatcgtnttcttactacttccttcccgcctacttcctatactatactactgtctgaagcggctacggcaacggcgacag

SEQ ID NO: 435240 - DNA, 753 bp, Homo sapiens
  misc_feature: GZ8MTXP02FO3OD.44.75.G09.1.454.CMB.2.raw
tcagacagtatatacacgaccggtgctcgatttagtatagacatcaggggtctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgccggccccaggacagagcgtcgccatctcctgctctaggaaacaactccaacattggtcgtaatcatgtacatagtaacaaaagtcgctggcctccggacccctaaagtccctactatttaatgagtaattcttaagaccggtcccctaccgtcggtaacttcctactacgtacccgtattcctctacgccttacgttaaacgtctacggtaacctttcacgtccctacgtttcggaccctaactcccgacccggtaccttacccgaacggtaccgtacgggaacggtaaccgggaacggtaccgtaacgtttaacgttaagttttcgggtttaggggtccgtttacgggggaccttacccgtaacggttcccggttttggggttgggggtttaccgggggtttttccggggaccgggggtaaacgggggtacccccggtaacggttaccgggtaaccccgggttacccgttaaacgggtaccccgtaaccgggaacccccggtaaacgggtcccccggtacccgggttaccccccccgttcggggttcccccttaaccccgg

SEQ ID NO: 435241 - DNA, 529 bp, Homo sapiens
  misc_feature: GZ8MTXP02HJX30.44.75.G09.1.454.CMB.2.raw
  modified_base (257)..(257): a, c, t, g, unknown or other
  modified_base (433)..(433): a, c, t, g, unknown or other
  modified_base (447)..(447): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggccttggtttcagcaggagcctggacaaacgcccctaagtccctgattcttttcnggatccactttgaagagtggagtcccagccaggttcagcggcagtggttctggggacactatttcactctcacccatcagcacgcctgccgacgccgtggagtatttccgacgtacttattactcgacccaataatattcttttatccgtatagtttcggcaggggacagctgganatacgaaagactgnggactgcaccatctgtcttacactcctccgctactctagactagttactactgtctgaacgcgggctaggacacggcgacag

SEQ ID NO: 435242 - DNA, 690 bp, Homo sapiens
  misc_feature: GZ8MTXP02G6LMI.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttctgatcctactttgaagagtggagtcccagcctaggtcagcggcaggtggttctggggacacgtactttccaacgtcctacctaccctatccaggcctacgcctgccgtacgccgtggagtatttcgcgtactttattactcgaccctaaactaaattactttactttttactaccgttaacgttagtttcggaccgtaacgggggaacctaacggtcgtagggtaagtagtaaccgaaaggtaaccgtaggtcggtacgttcggaccaaccgtacttccgtcggtttaccttaaccgttaccgttacccgtttcccccgacctaccgttacccgttagtaactttaaattaaaccgtttaaccttacggtttaccggtaggttaaccgggggaccgggttacggtcgggaaccggtaacggggtcccggtaacgtaacg

SEQ ID NO: 435243 - DNA, 515 bp, Homo sapiens
  misc_feature: GZ8MTXP02HDXVT.44.75.G09.1.454.CMB.2.raw
  modified_base (301)..(301): a, c, t, g, unknown or other
  modified_base (356)..(356): a, c, t, g, unknown or other
  modified_base (431)..(431): a, c, t, g, unknown or other
  modified_base (490)..(490): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggttcagcagagcctggacaaagcccctaagtccctgatcttttctggatccactttgaagagtggagtccagccagtcagcggcagtgtctggacanatttcatctcaccatcagcagcctgccagcctggatatttcgcgtacttattacngacccaaatatatttctttttatccgtatagtttgaccgagggaccaagcgtagagatacaaaagaactgtggangacacactctctctctactctccgtacctactactatactattactactacgtcgtagnggcggacgtcgacgacgacgacgag

SEQ ID NO: 435244 - DNA, 657 bp, Homo sapiens
  misc_feature: GZ8MTXP02HJB8B.44.75.G09.1.454.CMB.2.raw
  modified_base (298)..(298): a, c, t, g, unknown or other
  modified_base (307)..(307): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgacttctttctggactccactttgaagagtggagtcccagccaggttcagcggnagtggttcnggggacactatttcactctcaccatcagcagcctgccagccgtggacgtatttcgcgtacttacttactcgacctaaactaattactttacctttttactacccgttaacttacggttttcggtacccggtaacgggggtaacccaaaggtccgtagggtaagtagtaccgtaaaagggtaccgttaggtgggtacttcggtaccaaccctagttaccgttcgtcctttactaccttcccgttacccccgtacctacttacctacggtaaatttaccgtaaattacccgttagttccctttagggaacgggccggggtacgttccggggagaacggggccggtaccgaag

SEQ ID NO: 435245 - DNA, 519 bp, Homo sapiens
  misc_feature: GZ8MTXP02IZD42.44.75.G09.1.454.CMB.2.raw
  modified_base (445)..(445): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggtctgggacacatttcactctcaccatcagcagcctgccagcctggagtatttcgcgtactttattaactgacccaatattattctttttatccgttactagtttggccgtaggggaccagctaggagatacgaaaggaactggtacgntagcaccatctgtcttcacttctccgctatctagactatactactcgtctgaacgtcggctggcaggcgactag

SEQ ID NO: 435246 - DNA, 701 bp, Homo sapiens
  misc_feature: GZ8MTXP02GZ5H5.44.75.G09.1.454.CMB.2.raw
  modified_base (318)..(318): a, c, t, g, unknown or other
tcagacagtatatacacgaccggtgctcgatttagtatagacatcaggggtctgcttcagctgtgagcgcagaaggcaggactcgggacaatcttcatcatgacctgcctcccctctcctcctcacccttctcattcactgcgcagggtcctgggcccagtctgcattgacgcagcccgccctcagtgtctgccggcccaggacagagcgtcgccatctcctgctctaggaaacactccaacattggtacgtaatcatgtacataggtaaaccaaaaagtcgcgtggcctccggacccctaaagtccctactatttangaagtaattcttaacgaccgccctacgtcggtatcctctacgacgtacttcttctcgccttagttaacgtcgtacggtaactttcacgtccttaacgtttcggaccctaagttcccgacccggtacctaccgaacgtacgtagggaacggaaccggacggtaacccgtaagttttaacttaacggttttcgggttaggggttaccgtttcgggggaacccttccggtaacggttcccggtttagggggtttcgggggtttcggggggtttttaccgggaccggggtacggggtaaccccgtacggttaccggtacccgttaccgtaaacgtccgaaccgtacccgaacgggtccctaccgtcccccgtcggtaccttaccccg

SEQ ID NO: 435247 - DNA, 668 bp, Homo sapiens
  misc_feature: GZ8MTXP02FQOM5.44.75.G09.1.454.CMB.2.raw
  modified_base (304)..(304): a, c, t, g, unknown or other
  modified_base (322)..(322): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattcttttctggatccactttgaagagtggagtcccagccaggttcagcggcagtggttcngggacactatttcactcncaccatcagcagcctggccacgccgtaggatactttcgcgttacttattactagaccctaaactaaattatttccttttttactaccgttaactaggttttacggacccgtaagggggaaccctaaggtaccgttaggggaacgtaatacgtaaaaagggtaaccgttgggtacgggtactacggtaccaaacctacgtttcgtcgtttcctttacctaacgtttcccctttcccccggaaccttaacgttcccttaacggtaatttaaacctttaagttaccgtttcgttcccgttaaggcgggtccggggtcgtacggggtacgaaacggggtcaccggtaaag

SEQ ID NO: 435248 - DNA, 722 bp, Homo sapiens
  misc_feature: GZ8MTXP02FNA8H.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaagcccctaagtccctgacttctttctggactccactttggaagagtggagtcccagccaggttcagcggcaggtggttctgggacactatttcactctcacccatcagcagcctgcccagccgtggacgtagtttccgacgtacttacttaccttagacccctaaataaactttaacttttacctttttttaagttcccgttaacgttacgggtttttacgggacccggttaacgggggaacccgtaaaggcgttagggaagtaagtaaccgtaaaaagggtaaaccgtgggttacgggtacgttacggacctaaacccgtacttaccgttcggtttacctttaccctaacctttacccgtttccccgaaccctacctttaccctttaggtaaacttttaattaactttaaccgttacggttcccggtttaagggaaccgggtccgggggtaaccggttcggggtaaccgtaaacgggggccgtacctaaacgg

SEQ ID NO: 435249 - DNA, 584 bp, Homo sapiens
  misc_feature: GZ8MTXP02HU6NX.44.75.G09.1.454.CMB.2.raw
  modified_base (253)..(253): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggcctggtttcagcaggagcctggcaaagcccctaagtccctgatcttttcnggatccactttgaagagtggacgtcccagccaggttcagcgcagtggttctgggacactatttcacttctcaccatcagcagcctgcccagccctggacgtatttcgcgtctttatactgaccaaactaattactttactttttatccttacgtagttttcggccgtagggggaacctaacggcgttagggaagtaagtaccgaaaagggtaacttggttcggcttagccaaccctatcttagttcttactacttccctttacccccgctacttctatacttacttactcgtcgtcgtagaacggtcggtcgtcggacgacggcgtacgag

SEQ ID NO: 435250 - DNA, 591 bp, Homo sapiens
  misc_feature: GZ8MTXP02HV8GR.44.75.G09.1.454.CMB.2.raw
  modified_base (252)..(252): a, c, t, g, unknown or other
  modified_base (296)..(296): a, c, t, g, unknown or other
  modified_base (303)..(303): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggatccatttgaagagtgagtccagccaggtcagcgcagtgtcngggacanatttcactctcacctatcagcagcctgcccagcctggactatttccgcgtacttattactgaccctaaataattactttactttttacaccgttacgttagttttcggaccgaaggggtacccaaaggtcgtagggaacgtataccgaaaaggtacgttaggtacgtcgttacgacaaccctaatcgtgttacttctaacttccttaccccgacctattacctagtaacttattaacttaacgttcgtcgttaggaacggccgggtatcgggactaacggcgtactag

SEQ ID NO: 435251 - DNA, 584 bp, Homo sapiens
  misc_feature: GZ8MTXP02H8IH6.44.75.G09.1.454.CMB.2.raw
  modified_base (305)..(305): a, c, t, g, unknown or other
  modified_base (323)..(323): a, c, t, g, unknown or other
  modified_base (383)..(383): a, c, t, g, unknown or other
  modified_base (531)..(531): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggccttggtttcagcaggagcctggcaaacgcccctaagtccctgtattcttttctggactcctactttgaagagtggacgtccccagccgtaggtcaggcggnaggtggtctgggacactnttcactctacacatcagcacgcctgcccagcctggagtatttcgacgtactttagttacncgtacctaaactaacttatttactttttactccgtattagtttcggacgaacggggtaccaaagtcgtagggaagtataacgaaaaggtactaggtgtacgtgaccacctatcttgttccttctacttcccgttcccgctactacttntacttatactacgtcgtcgtagtcggtcggacggtcggacgtacggctacgag

SEQ ID NO: 435252 - DNA, 660 bp, Homo sapiens
  misc_feature: GZ8MTXP02GW0YD.44.75.G09.1.454.CMB.2.raw
  modified_base (254)..(254): a, c, t, g, unknown or other
  modified_base (302)..(302): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctgacaaacgcccctaagtccctgacttcttttcnggatccactttgaagagtggagtcccagccaggtcagcggcagtgtcngggacacattcactctcacatcagcagcctgcccagcctggacgtattccgctacgtttattactcgacctaaactaatttactttaccttttttaactcccgttaacgttacggtttttacgggaccgtaacgggggaacctaaggtcgtagggaagtaactaacgaaaacgggtacttgggtacgggtcttacggacctaacctaacgttccttacggtttcctttactaacctttcccttaccccgtacccttacttacccgttataactttaacttaacttaaccgttcgtaccgtttaggaacggggtccggggtccggttacggggaccggaacggtaccggaccgtaaacg

SEQ ID NO: 435253 - DNA, 522 bp, Homo sapiens
  misc_feature: GZ8MTXP02GYSZ3.44.75.G09.1.454.CMB.2.raw
  modified_base (249)..(249): a, c, t, g, unknown or other
  modified_base (315)..(315): a, c, t, g, unknown or other
tcagacagtatatacacgaccggtgctcgatttagtatagacatcagggacttaggggctttgccaggctcctgctgctctgtttcccctgtgccaggtgtgacatcgagatgacccagtctccgtcctcactgtctgcgtctattggggacagagtcaccatcacttgccgggcgagtgccgacattaggacttttttggcctggttcagcaggagcctggcaaagcccctaagtccctgatctttcngatccattgaagagtgatcccagccaggtcagcggcagtggtctgggacacatttcactctcaccntcagcagcctgcagcctggatattcgcgtacttatactcgaccaactattacttactttttatccggttactagttttacggccgtagggggtaccaagtccgtagggacgtagtacgaaaggactaggtgctgcaccgatctgtcttcatccttcccgaccatctcgatatactactgtactgacgcgggtctgggacacggcgag

SEQ ID NO: 435254 - DNA, 529 bp, Homo sapiens
  misc_feature: GZ8MTXP02JI4Q4.44.75.G09.1.454.CMB.2.raw
  modified_base (254)..(254): a, c, t, g, unknown or other
  modified_base (320)..(320): a, c, t, g, unknown or other
  modified_base (354)..(354): a, c, t, g, unknown or other
  modified_base (370)..(370): a, c, t, g, unknown or other
  modified_base (421)..(421): a, c, t, g, unknown or other
  modified_base (475)..(475): a, c, t, g, unknown or other
  modified_base (481)..(481): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttggccttggttcagcaggagcctggcaaacgcccctaagtccctgtattcttttcnggactccactttgaagagtggactcccagccaggttcagcggcagtggttctgggacacatttacnctctcacccatcagcagcctgcccagcctgagtnttcgcgtacttatacngaccaatatatttcttttatctactgtttcggcgtaggggacagcgtgganagtacaaaggtctaggtcgactaggccatactcctgtcttcacttccttacccnctactntatatattacgtacgtcgtcgagcggtcggtcgacggacgacgcagag

SEQ ID NO: 435255 - DNA, 674 bp, Homo sapiens
  misc_feature: GZ8MTXP02FS7G0.44.75.G09.1.454.CMB.2.raw
  modified_base (257)..(257): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtgccgacattaggtacttttttggccttggtttcagcaggagcctggacaaacgcccctaagtccctgattctttcngactccactttgaagagtggagtccccagccaggttcaggcggcaggttggttcgtgggactactatttccactctcaccatcagcagcctgcccacgcctaggagtactttccgacgtacctttattacgtagaccctaaactaatttactttcctttttttaacttacccgtttaaccgttaggtttttacgggcccgaagggggtaacccaagtcgtaggtaagtaaacgtacgtaaaacgggaacttaggtacgggtcttacggaccgtaaccctaacttccgttcgttcctttactaacctttccctttacccccggaccctaaacttcccgttaagtacttaaattacttaaccgttcgttacgttcggaacgggccggggtcgtacgggtacgaaacgggccgtactaag

SEQ ID NO: 435256 - DNA, 508 bp, Homo sapiens
  misc_feature: GZ8MTXP02HX4HJ.44.75.G09.1.454.CMB.2.raw
  modified_base (252)..(252): a, c, t, g, unknown or other
  modified_base (302)..(302): a, c, t, g, unknown or other
  modified_base (365)..(365): a, c, t, g, unknown or other
  modified_base (387)..(387): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgatcttttcnggatccactttgaagagtggagtcccatccaggttcagcggcagtggtcngggacacatttcactctcaccatcagcagcctgccagcctggagatttcgcgactttattacngaccaacaatattctttttacncgtactagtttggccagggggaccaagctggagatcaaaaggactgtaggctgcacatctgttctcatctcccgctactctgactatatactgtctgaagcgggtctggacgaaggcacga

SEQ ID NO: 435257 - DNA, 518 bp, Homo sapiens
  misc_feature: GZ8MTXP02FEXBZ.44.75.G09.1.454.CMB.2.raw
  modified_base (515)..(515): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaagcccctaagtccctgatctttctggatccactttgagagtggagtcccagccaggttcagcggcagtggttctgggacacatttcactctcaccatcagcagcctgccagcctggagatttcgcgtacttattactgacccaaactaattattcttttttatcccgttactagttttggcctagggggacccaaaggctaggagatcaaaggaactgtggctgcacatctgtcttcatccttcccgccatctgactatactactgtctgaacgcgggactggcaaggcncag

SEQ ID NO: 435258 - DNA, 516 bp, Homo sapiens
  misc_feature: GZ8MTXP02FE3RF.44.75.G09.1.454.CMB.2.raw
  modified_base (423)..(423): a, c, t, g, unknown or other
  modified_base (443)..(443): a, c, t, g, unknown or other
  modified_base (496)..(496): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggttcagcaggagcctggcaaaagcccctaagtccctgattctttctggatccactttgaagagtggagtccccagccaggttcagcggcagtggtctgggacacatttcactctcaccatcagcagcctgcccagcctggatatttcgcgtacttatactgaccaaacaatattctttttatccgttactagtttgcgaggggaccaagctagganatacgaaaaggactagtggntgacacatctgtcttcatcttcccgctactctatactatactactgtctaggngcggcgcgacgacgacgaca

SEQ ID NO: 435259 - DNA, 573 bp, Homo sapiens
  misc_feature: GZ8MTXP02JFKBL.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgacttcttttctggatccactttgaagagtggagtcccagccaggttcagcggcagtggttctgggacactatttcactctcaccatcagcagcctgcccagcctggagtatttcgcgtactttattaactcgaccaaataattactttctttttacttccgttactagtttacggtccgagggaccgacgcgtaggagagtacgaaaggaactatggggggggctgcgacactctcgttcttctacttcctcccgtcctacttctagtacttaattacttacgttcgtcgtcgtaacggtcgggtcgtcggacgaacggcgacgtaag

SEQ ID NO: 435260 - DNA, 504 bp, Homo sapiens
  misc_feature: GZ8MTXP02F2IZV.44.75.G09.1.454.CMB.2.raw
  modified_base (344)..(344): a, c, t, g, unknown or other
  modified_base (369)..(369): a, c, t, g, unknown or other
  modified_base (382)..(382): a, c, t, g, unknown or other
  modified_base (413)..(413): a, c, t, g, unknown or other
  modified_base (461)..(461): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggttcagcaggagcctggcaaagcccctaagtccctgatctttctggatccactttgaagacgtggagtcccagccaggttcagcggcagtggtctgggacacatttcactctcacccatcagcagcctgccagcctgganatttcgcgtactagtaactgccaanaatatctttttanccgttacagtttgctaggggaccagctgganatcaaaggacagtgctgacacatctgtctttcactcttcccgcactcngatatactactcgtctgaacgcgggactcggcaaggcgctaag

SEQ ID NO: 435261 - DNA, 563 bp, Homo sapiens
  misc_feature: GZ8MTXP02I7FZY.44.75.G09.1.454.CMB.2.raw
  modified_base (251)..(251): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggatcccagccaggtcagcggcagtggttctgggacactatttcactctacaccatcagcagcctgccagccgtggactattccggctacttattactgaccaactaattcttactttttactccgttactacgtttcggaccgtaaggggacctaaggctaggacgatacgaaaggaacgtgtacggctcgacaacctacgtctgtcttctactccttcccgctactctagtacttatacttacgtacgtcgtagaacggtcgggtcgtacgggacgaaacggtccgactaag

SEQ ID NO: 435262 - DNA, 511 bp, Homo sapiens
  misc_feature: GZ8MTXP02FW4A7.44.75.G09.1.454.CMB.2.raw
  modified_base (418)..(418): a, c, t, g, unknown or other
  modified_base (473)..(473): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggatcccagccaggttcagcggcagtgtctgggacacatttcactctcaccatcagcagcctgccagcctggatatttcgcgtacttattactgaccaactaattattctttttatcgttactagttttcgcgagggtaccaagctgganatacgaaaaggactagtcggctgacacatctcgtcttcatctcccgctactctanatactatactgtctagaagcggctcggacgagcgacta

SEQ ID NO: 435263 - DNA, 703 bp, Homo sapiens
  misc_feature: GZ8MTXP02FND4G.44.75.G09.1.454.CMB.2.raw
  modified_base (306)..(306): a, c, t, g, unknown or other
  modified_base (315)..(315): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgacttctttctgactccactttgaagagtggagtcccagccaggttcagcggcagtggttcngggacactntttcactctcaccagtcagcaggcctgccccgaacggccccggagtactttcggccgtaactttattacctacgtaccctaaaactaaactttaacgttttacctttttttaaacgttaccccgtttaaacgtttacggtttttacgggacccggttaaacggggggaacccctaaaaggtccgttagggaaggtaacttaacgaaaacggtaaacgttggtagggtcttggacctaaccgtattacccgtttacgtttccttaccttaaccttccccgttaccccgtaccttaacgttacgttacgtaaacttaacgttaacttacgttcgttacgtacggacggtaacggggtacggtacggacggtaacggacgacgtaagtacg

SEQ ID NO: 435264 - DNA, 579 bp, Homo sapiens
  misc_feature: GZ8MTXP02IC50I.44.75.G09.1.454.CMB.2.raw
  modified_base (255)..(255): a, c, t, g, unknown or other
  modified_base (328)..(328): a, c, t, g, unknown or other
  modified_base (485)..(485): a, c, t, g, unknown or other
  modified_base (524)..(524): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgtatcttttcnggatcctactttgaagagtggacgtcccagcctaggttcagcggcaggtggttctgggacactatttcactcncaccatcagcacgcctgccctagccgtggacgtatttccgcgtactttattactcgacctaaactaactttatttctttttactaccgttacgttacgttttcggaccgtaaggggacctaagcgtaggaacgtataacgaaaggacttggtcggtntcgacactattcttgtctctacttcctcccgctactctnattactacttactcgttacgtggaacggcggtacgtacggacgaacggctacgag

SEQ ID NO: 435265 - DNA, 745 bp, Homo sapiens
  misc_feature: GZ8MTXP02GFDCB.44.75.G09.1.454.CMB.2.raw
  modified_base (257)..(257): a, c, t, g, unknown or other
  modified_base (296)..(296): a, c, t, g, unknown or other
  modified_base (306)..(306): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggacgcctggaccaaacgcccctaagtccctgattctttcngactccactttgaagagtgactccagccaggtcagcggnaggtgttcgnggacacgtatttccactctacaccatcagaccagcctgaccgacgtccgtaggacgttacttcccggtacgttacctttacgttaccgtacgtaaaccctaaaacttaaactttacttttactttttttaaccgtacccgtttaacgtttaaccggtttaaccgggtacccggtaaacgggggtaaccctaaacgggtccgttagggaacgtaacgtaaccgaaaaggtaaaccgttggtacggtaccgtacggtaacccgtacccttaaacggttaccttcggtttaaccctttccgttaaccgtttcccccgttacccccgtaacctttacttacccgttaacggttaactttaaccggttaattaccgttgttaacccgttgggaaccggtttcgggtaccggtacgggaacgaacggggtacccgtaaacgtacg

SEQ ID NO: 435266 - DNA, 675 bp, Homo sapiens
  misc_feature: GZ8MTXP02G4SJH.44.75.G09.1.454.CMB.2.raw
  modified_base (309)..(309): a, c, t, g, unknown or other
  modified_base (322)..(322): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggtctgggacacntttcactctcacntacagcagcctgccagcctggactatttcgcgtacttacttactgaccaataattacttctttttaactccgttaacttagtttcggaccgacgggggtaacctaaggtcgttagggaagtacgtaaccgaaaagggtaccgttaggtacgggtcttaggacctaaccctaacgttccttacggtttcctttaacctaccgtttacccctttcccccgtaccccgttaaacgttcccttaacggtaaactttaattaaactttaaacccgttcggtttaccctttagggggaaccggtccgggggttccgttacggggtaacccggtaaaacggggtccgtaaccggtaaacg

SEQ ID NO: 435267 - DNA, 702 bp, Homo sapiens
  misc_feature: GZ8MTXP02HX0GB.44.75.G09.1.454.CMB.2.raw
  modified_base (343)..(343): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggacgcctggacaaacgtcccctaagtccctgtacttctttttctggtactcctacgtttgaagtagtggacgtcccagccaggttcagcggctaggttggtctgggactactacttcactctcacntcagcacgctgcccgacgtccgtaggtaacgttcgtttccgacgttactttacttaccgtacaccctaaataactttatttttactttttacaccgtttacgtagttttcggaccggtaacggggtacctaacgggtcgtaaggggaactaacgtaacggtaaaggtaacggttggtccgggttactacggtacccaaccgttagttccttacggtttccttacttaccggtttccctaccccgttacctactttaccgtaattaacctttaatttaccgttaacgtttaccggtcggttaagggaacgggtccccggggttaagtcgggaccggtaaacggggtccctaacgtaacgg

SEQ ID NO: 435268 - DNA, 725 bp, Homo sapiens
  misc_feature: GZ8MTXP02IF8G1.44.75.G09.1.454.CMB.2.raw
  modified_base (261)..(261): a, c, t, g, unknown or other
  modified_base (309)..(309): a, c, t, g, unknown or other
  modified_base (327)..(327): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctgggacaaacgcccctaagtcccctgtacttctttttcnggactccctactttgaagtagtggacgtcccacgccaggttcagcggnaggtggttctgggacacntttcactctcaccatcagcagcctgcccagcctggacgatttccgacgtctttattactcgaccctaaactattactttactttttactaccgttacttagtttcgggaccgtaacgggggtaccctaacggtacgttacggggaagtacgttaaccggaaaaagggtaaaccttagggttacgggtaccgtttaccgggtacccaacccgtaacgtttccttcggtttaccgttttcccgtaaacctttccccgtttccccccgtacccgttaactttcccgtttacggtaaaactttacgtttaaactttaccccgtttaacggtttacggacggggttaaccgggggccgttacggggaccggaaaacggggttcccggaaccgtaaggtaacgg

SEQ ID NO: 435269 - DNA, 573 bp, Homo sapiens
  misc_feature: GZ8MTXP02JRQ0E.44.75.G09.1.454.CMB.2.raw
  modified_base (256)..(256): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttggccttggtttcagcaggagcctggacaaacgcccctaagtccctgacttcttttcnggatcctacttgaagagtggagtcccagccagtcagcgcagtgttctgggacactattcactctcaccatcagcagctgccagcctggactattcgacgtactttagtactcgacctaaataatttactttacttttttactaccgttaacgttacggttttacggacccgtaagggggtaacccaaggtacgtaggaacagtaacgaaaaggacgtagtaggtcgtacgacacctatcgttgttctactactcctcctactactactatactactactactcgtcgtacgtaacggcgtcgcgacgacgacgacag

SEQ ID NO: 435270 - DNA, 506 bp, Homo sapiens
  misc_feature: GZ8MTXP02H0WZW.44.75.G09.1.454.CMB.2.raw
  modified_base (250)..(250): a, c, t, g, unknown or other
  modified_base (345)..(345): a, c, t, g, unknown or other
  modified_base (350)..(350): a, c, t, g, unknown or other
  modified_base (360)..(360): a, c, t, g, unknown or other
  modified_base (366)..(366): a, c, t, g, unknown or other
  modified_base (379)..(379): a, c, t, g, unknown or other
  modified_base (405)..(405): a, c, t, g, unknown or other
  modified_base (444)..(444): a, c, t, g, unknown or other
  modified_base (461)..(461): a, c, t, g, unknown or other
  modified_base (505)..(505): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggatcccagccaggttcagcggcagtggttctgggacacatttcactctctacccatcagcagcctgcagcctgganttcgngtcttatacngccaanatattctttttancgtactagtttcgcagggacaagtcngagatacaaaggtactgtggtactgcacatctgtctacncgtctcccgctctcttntactatactacgtcgtcgtcgcggcggtcgcgacgacgacgcgng

SEQ ID NO: 435271 - DNA, 507 bp, Homo sapiens
  misc_feature: GZ8MTXP02JYG0D.44.75.G09.1.454.CMB.2.raw
  modified_base (309)..(309): a, c, t, g, unknown or other
  modified_base (344)..(344): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacanattcactctcacatcagcagcctgccagcctgganatttcgcgtacttattactgccaaacaattattcttttatccgtactagtttgcaggggacaagctggagatcaaaggaactgtaggctgcaccatcctgtcttcatctcccgctactctagatactatactcgtactgtaagcgggctcggacacggcgaca

SEQ ID NO: 435272 - DNA, 560 bp, Homo sapiens
  misc_feature: GZ8MTXP02FGF0K.44.75.G09.1.454.CMB.2.raw
  modified_base (267)..(267): a, c, t, g, unknown or other
  modified_base (512)..(512): a, c, t, g, unknown or other
  modified_base (528)..(528): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatctttctggatccactttgaagngtggagtcccagccaggttcagcggcagtggttctgggacacatttcactctcaccatcagcagcctggcccagcctggatagtttccgcgtacttagttactgaccaaactaatttacttctttttttaactcccgttaactaaggtttttcggaccgtaaggggacccaaagcgtaggtagatacgaaaacggaaactagtggctgaccgacactctcgttcttcactcttcccgccacttcntaatactatactcgtntacgaagtcggaccgtggaccgaggcgacgag

SEQ ID NO: 435273 - DNA, 660 bp, Homo sapiens
  misc_feature: GZ8MTXP02I3M5C.44.75.G09.1.454.CMB.2.raw
  modified_base (310)..(310): a, c, t, g, unknown or other
tcagacagtatatacacgaccggtgctcgatttagtatagacatcagggacttaggggctttgccaggctcctgctgctctgtttccccggtgccaggtgtgacatcgagatgaccccagtctccgtcctcactgtctgcgtctattggggacagagtcaccatcacttgccgggcgagtgccgacattaggtacttttttggccttggtttcagcaggagcctggccaaacgcccctaagtccctgtacttcttttctggactcctactttgaagagtggagtcccagcaggttcagcgcagtggttcngggacactatttcactctcacccatcagcagtcctgaccagccgtaggagtacgtttccgacgttactttaattacgtacgaccctaaataaactttatttacctttttaactacccgtttaacgttacggtttacggacggaaacgggggtacctaaacggtcgtacgggtagaaacgtacgtaaaaacgggtaacgttggtacggtcgtacgacctactacgtacgttcgttactttactaccgtttaccttccccgtacctaacttccgtagtaacgttattaacttaccgtaggttccgttaggaacggtcccgggtagtacgggacgtaaacgggacgtacgtag

SEQ ID NO: 435274 - DNA, 669 bp, Homo sapiens
  misc_feature: GZ8MTXP02G7SWM.44.75.G09.1.454.CMB.2.raw
  modified_base (268)..(268): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagngtgagtcccagccaggtcagcggcagtggttctgggacacatttcactctcaccatcagcagcctgccacgcctggacgtatttccgacgtacgtttattactcgaccctaaataatttactttacttttttaactccgttaacgttagttttcgggaccgtaagggggtacccaaaggccgttagggaagtacgttaacgaaaacgggtaaaccttgggtacggtaccgttacgggacccaaaccctacttacccggtttacgttcccgttacctacccgtttccccgttaccccgtaaccttaccgttaccgttacgtaactttaaacttaacgttacgttacgttacgtacggtaaccgggtcgggtacggtacgggacgtacggtacgtacgtaacg

SEQ ID NO: 435275 - DNA, 547 bp, Homo sapiens
  misc_feature: GZ8MTXP02FSKYU.44.75.G09.1.454.CMB.2.raw
  modified_base (252)..(252): a, c, t, g, unknown or other
  modified_base (302)..(302): a, c, t, g, unknown or other
  modified_base (395)..(395): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattctttcnggatccactttgaagagtggatcccagccaggttcagcggcagtggttcngggacactatttcactctcaccatcagcagcctgccagcctggagtatttccgcgtacttatactgacctaactaattactttcttttttacnccgttacttagttttcggaccgtagggggaccagtcgtaggagactacgaaaggtactgtcggctgccactactctgtcttcacttccttcccgctactcgtatacttatactacgtgtctagtaacggcgggtactggacgaggccgacag

SEQ ID NO: 435276 - DNA, 545 bp, Homo sapiens
  misc_feature: GZ8MTXP02I6YNT.44.75.G09.1.454.CMB.2.raw
  modified_base (311)..(311): a, c, t, g, unknown or other
  modified_base (328)..(328): a, c, t, g, unknown or other
  modified_base (445)..(445): a, c, t, g, unknown or other
  modified_base (504)..(504): a, c, t, g, unknown or other
  modified_base (529)..(529): a, c, t, g, unknown or other
  modified_base (544)..(544): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtactttttttggccttggtttcagcgaggacgcctggacaaacgcccctaagtccctgtattctttctggactccactttgaagagtggagtccagccgagttcagcggcagtggttcngggacacgattcactcncacccagtcacgcagcctgccacgccgtggatacgttccgcgtactttacttactgacccaaatattacgtttctttttactcgttactgtttacgcgacggggacaagcgtagganagtacgaaagtaacgtggacgcgtgactaccatctgtcttcaccttcctccactctctntactattactagtctgtgcgtcggngtcggacaggcgacng

SEQ ID NO: 435277 - DNA, 626 bp, Homo sapiens
  misc_feature: GZ8MTXP02HK2LK.44.75.G09.1.454.CMB.2.raw
  modified_base (255)..(255): a, c, t, g, unknown or other
  modified_base (355)..(355): a, c, t, g, unknown or other
  modified_base (516)..(516): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagttccgactattaggtacttttttggccttggtttcagcaggagcctggcaaacgcccctaagtccctgattctttnggtactcctacgtttagaagtagtggacgtcccggcaggttcaggcggcaggtgttcgtgggacactatttcactctacacctatcagcacgcctgacgngcccctaggactcgtttcgacttactttatcgtcgacaactagtaattaagtagtttactactacgtaggttagtttacgggaccggtaacgggggaaccaaggtcgtaaggacgtactaacgaaaccgtagtagtcggtactacgacctacctctcgttntccttctacttcccgttacccgacttacgtacctaggtacttaaacttacttaaccgtgttccgagggtaacggccgggtacgttacgggacgtaacggccgaacgtaag

SEQ ID NO: 435278 - DNA, 709 bp, Homo sapiens
  misc_feature: GZ8MTXP02H80L7.44.75.G09.1.454.CMB.2.raw
  modified_base (259)..(259): a, c, t, g, unknown or other
  modified_base (277)..(277): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcaggagcctggacaaacgcccctaagtccctgtacttcttttcnggactcctactttgaagngtggacgtcccagccaggtcagcggcagtggtctgggacactattcactctcaccatcagcacgcctgcccacgccgtaggagtatttccggctactttattactcgacctaaactaattacttttctttttaactacccgttattacggtttacgggacccggtaacgggggtaaccctaaaggtccgttaagggaacgtaacgtaaacggtaaaacgggtaaccgttacgggtaggggtacttacgggtaaccaacccgtaatttccgttccgggtttacctttaccgtaacctttccccctttacccccggtaccttaacgttcccgtttaacgtaactttaaagtttaacttaaccgttcggttaccttaggggaacggtcgggggtaacccgttggggaaccgtaaacgggggcccttaacgtaagg

SEQ ID NO: 435279 - DNA, 695 bp, Homo sapiens
  misc_feature: GZ8MTXP02I978A.44.75.G09.1.454.CMB.2.raw
  modified_base (253)..(253): a, c, t, g, unknown or other
  modified_base (268)..(268): a, c, t, g, unknown or other
  modified_base (273)..(273): a, c, t, g, unknown or other
  modified_base (297)..(297): a, c, t, g, unknown or other
  modified_base (305)..(305): a, c, t, g, unknown or other
  modified_base (313)..(313): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgatcttttcnggatccatttgaagngtggntccagccaggtcagcgcagtggtntgggacanattcatcncacatcagcagcctgacccacgccgtgagtactttcgctacttattactgacccaaataactttatttacctttttaagtcccgtttaacgtaggttttacgggaccgttaaacgggggaaccaaaggtccgttaggggaataaacgttaaccgaaaaacgggtaaacgttggggttacggccggttacgaccctaaaccccgtaagtttccgttaacgtttcctttactaacggtttacccccgtttcccccgaccccttaaacgtttacgttaacgttaaacttaaacttaacgttaaccgtttacggtaccggttacgggaaccggggtaccggggttacggtacgggtaaaccggaaaccgggaccgttaacgtaacg

SEQ ID NO: 435280 - DNA, 729 bp, Homo sapiens
  misc_feature: GZ8MTXP02JBINF.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggccttggttcagcaggagcctggacaaacgcccctaagtccctgtattctttctggtactccactttgaagagtggagtcccagccaggttcagcggctaggtggttcgtgggactactatttcactctacaccatcacgcagtcctgccacgccgtaggatacgtttcgacgttactttaacttactacgaaccctaaaacttaactttaacttttcctttttttaaacgtacccggttttaacgtttagggtttttaccggggacccggtaaacgggggtaaccccgtaaaggttaccggttaagggtaaacggaaacgttaacccggaaaaaggggtaaaccgtttacgggtacgggtccttaccgggacctaaccccgttaattccgttcgtttaccttccgttaaccttccccgtttccccggaacctttaacttcccgttaatactttaaactaaactttccgtacgttccgttaaggccgggttacggggaccgttcgggacgtaacgggccgtactagg

SEQ ID NO: 435281 - DNA, 688 bp, Homo sapiens
  misc_feature: GZ8MTXP02JVHG9.44.75.G09.1.454.CMB.2.raw
  modified_base (219)..(219): a, c, t, g, unknown or other
  modified_base (316)..(316): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggcagagtcaccatcacttgccgggcgagtgccgactattaggtacttttttggcctggtttcagcaggngcctggacaaacgcccctaagtccctgtattctttctggactcctatttggaagaggtggacgtcccagcctaggtacaggaggctaggttggttcnggggactacgtatttccacttcctccaacccataccgacgacgacgtccgtacgacccgaccgtccggtaggtacgttacgttacgtaccgttacttacttaccgtaccgtaacctaaacttaactttactttttacgtttttactaccggtttacgtttacggggttaccggaccgggtaacggggtaacgaggtaccgtagggaactagaaacggtaaaggtaccgttggggacgtacgtaccgactaaaccgttctcgtttacttaccttacttaccccgttcccgttacccgacttactactagtaacttacttactacgttcgtcgtaggaaccgggtcgacggtacgaccggacggtaccatacgg

SEQ ID NO: 435282 - DNA, 611 bp, Homo sapiens
  misc_feature: GZ8MTXP02FLIJ9.44.75.G09.1.454.CMB.2.raw
  modified_base (263)..(263): a, c, t, g, unknown or other
  modified_base (609)..(609): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtgccgactattaggtactttttggccttggttcagcaggacgccgtggacaaacgtacccctaagtccctgtacttctttcgngtactcctagttagagagtggactccgagcgtagtcgagcggcgtaggtgtcgaggactatattcactctcacgtatcgagccacgtcctgccccgtacgtccgtaggtacgttacgtttaccggacttactttacgtactacgtaaacctaaacttaatttacttttctttttaacgcgtttaacgttcgtttacggaccggtaagggtaccaacggtgtaggagtaacgaacgtaaaggtccgttaggcgtacgacgtacctaactcttctcttcttactacggttccctccactattacgtatactacgttatccgtcgtcgagcggcggcgagacgagcganag

SEQ ID NO: 435283 - DNA, 716 bp, Homo sapiens
  misc_feature: GZ8MTXP02HFKTA.44.75.G09.1.454.CMB.2.raw
  modified_base (316)..(316): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggcctggtttcagcaggacgcctggacaaacgccccttaacgtccctgtactttcttttcgtaggtactccttactttaggaagtaggtggactcccgacgctaggttcagcggntaggttggtcgtgggactacgtacttcactctaccacgactacgacgtaccgacgccgtcgacctacggcccgtaggtacgttctttaccggacgttactttaacgttactacgtacctaaacttaacttactttttactttttacgttacgttactttagggttacggacggtacggggtaaccctagacgttaacgggataacggtaagtaaaagggtaccgttggtcgtacgtagcccttaaactctccgtttaacttccgttaccttacccttacccggttccaaccccgtttagtaccctttaacggtaattaaacttacgtttaaccgttcgtccgttaaggggaaccggtcgggggttaccgcgggttaaacggtacgacccgggtaagtacg

SEQ ID NO: 435284 - DNA, 755 bp, Homo sapiens
  misc_feature: GZ8MTXP02JOPKS.44.75.G09.1.454.CMB.2.raw
  modified_base (254)..(254): a, c, t, g, unknown or other
  modified_base (272)..(272): a, c, t, g, unknown or other
  modified_base (296)..(296): a, c, t, g, unknown or other
  modified_base (305)..(305): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgattctttcnggactcctactttgaagngtggcgtccagcctaggtcagcgnaggtggtcngggacactattcactctcacatcagcacgtcctgccctacgtccgtagggtaacgtacgttttccggacgttactttacgttaaccgtaccgtaaccctaaaactaacttttaacttttacctttttttaaacgtccccggtttaaacgtttacgggttttaccgggtacccgggtaaacgggggtaaccctaacgggtaccgtaacggggtaaagtaacggttaaacggtaaaaacgggtacgttcgggtacgggtacgtaccggtaaccgtaacccgtactttaccgttaccggtttccgtttaccgtaacctttcccccggtttacccccgtaccttacctttaccgtacgttaaacgtttaactttaacgtttaaccgttcgttaaccgtcgggtaaccgggtcgggtacccggttagggaaccggtaacggtccggtaacgtacg

SEQ ID NO: 435285 - DNA, 776 bp, Homo sapiens
  misc_feature: GZ8MTXP02H6AAQ.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttgggccttgggtttcaggcaggagcctggaccaaacgcccctaagtccctgtattcttttcgtaggtacttcctactttggaaggtaggtcggacgtccccagcccgaggttaccaggccggcgtaggttcgggtttcgacggggaactaccgttatttcccaccttctaccaaccctataccgacgtccgaacggtccccgttcggacccccgacggtacccggttagggtacgttacgtttacccgacggttacttttaacttaccgtacggtaaccctaaacgttaactttactttttaccgttttttaaacccgttaccggttaaccgtttacggggttttaccgggacccgggtaaacgggggtaacccgtaaacggttcgggtaaggtaacgtaaacgtaacggtaaaacggttaccggttaggtaccgggtacgtacgggacccctacgtaacgttccttacggtttacctacgttaccttccccgggtaccctccctaatccggtattactaatacgttactcgtacgtacggcggccggggttacgcggacggtacggacggactag

SEQ ID NO: 435286 - DNA, 664 bp, Homo sapiens
  misc_feature: GZ8MTXP02JXMAM.44.75.G09.1.454.CMB.2.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggtctgggacacatttcactctcaccatcagcagccctgcccagcctggatactttcgacgtactttattactcgaccaactaaactttacttttacttttttactacccgtttaacgttacggtttttcggacccgtaagggggaaccctaaggtccgtagggaacgagttaaccgaaaagggtaaccgtggttcggacgttacgacctaactacttccgttcgttcctttacgtacttaccccgttttccccgacccttacgttcccttagtaactttagttaactttaacccgttggtaacccgtttagggaaccgggtccgggggtttcgtacggggtaacccggaggcccggttaaacgtacg

SEQ ID NO: 435287 - DNA, 683 bp, Homo sapiens
  misc_feature: GZ8MTXP02IKDHI.44.75.G09.1.454.CMB.2.raw
  modified_base (260)..(260): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacatttaggtacttttttggccttggtttcagcaggagcctggacaaacgcccctaagtccctagtacttcttttcnggtatcctattgaagtagtgagtccagcagtcagcggcagtggtctgggacactattcactctacacatcagacagtctgaccgacgccgtaggacgttatttaccggactactttaattaactacgaccctaaattactttaacttttactttttacttacgtaacgtttacggtttacggaccggtaacggggaacctaacggtcggttaggaagtacgttaacgaaaacggtaccgttggttaacggacgttcgtaaccgtaacctacgttacctttaggtttaccttaccgtaaccttacccgtttaccccggactaaccggtttacttacggtaaactttaaacgttaaacgtttaccgttacgtttaccgttaggaaccggtcgggtacgtacggtaacgtacggaccgtaagaacg

SEQ ID NO: 435288 - DNA, 647 bp, Homo sapiens
  misc_feature: GZ8MTXP02F8O0D.44.75.G09.1.454.CMB.2.raw
  modified_base (76)..(76): a, c, t, g, unknown or other
  modified_base (81)..(81): a, c, t, g, unknown or other
  modified_base (193)..(193): a, c, t, g, unknown or other
  modified_base (263)..(263): a, c, t, g, unknown or other
  modified_base (274)..(274): a, c, t, g, unknown or other
  modified_base (291)..(291): a, c, t, g, unknown or other
  modified_base (293)..(293): a, c, t, g, unknown or other
  modified_base (480)..(480): a, c, t, g, unknown or other
tcagacagtatatacacgaccggtgctcgatttagtatagacatcaggggacttagggctttgccaggcgtcctcnctcgntacttcgttcccggtgttccagttgtgacatcgagatgaacccagtctccgtcctcactgtcgtgtggtctagtggggactaggtacttctactatttcaacgttgccgggngtagtggcgacattaggtacttttttgggccttggtttcagggcaggtgcctggcaaaggccctagtccngacttctttcnggatccaatttcgaagngngatcccagtccaggttcagcggacaggtggtctgggaccacgatttccacgtcgtacgaccagcgtaggcgacgtcctagaccgaagcctaggatacttcgactacgtataccgtgacctaatattagtttaacgttttaagtccgtaacttagtttcgaccgaagggtaccaagtcgtaaggtaanaatacaaagtacgtgtacggtctgacaaatactactcttaactaacgtaccgttaccttacccggaccttattacggttagtacgtttaaacgtaatttaaccggaagtttacgtaggaaaccggtcggggtacgtttacggggaaaccggtacggtacgacgtaag

SEQ ID NO: 435289 - DNA, 637 bp, Homo sapiens
  misc_feature: GZ8MTXP02JSOPG.44.75.G09.1.454.CMB.2.raw
  modified_base (358)..(358): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccaggcgagtcgccgacattaggtacttttttggccttggttcagcgaggagcctggacaaacggcccctaagtccctgtacttctttctggactccctactttagaagtagtggacgtcccagccgtaggttcgagcggtacgtaggttcggtcgtacgggacactattcactctaccactatcagcncgcctgcctagctaggagtcgttcgcgttaacttactacctcgtaacctaaactatttactttactttttacaccgttagttacgtttcggacgacggtacaggtcgtagacgaacgtaaggtaaagtagtacgggtacgcgttaccggacctacctaacgtttgtaccgttaccttccgttacctcccggtacccctactacttcggttaacctaaattctttactcggttcttaccggcggtacggacccgggtgtaccggagtaacgggccgtaag

SEQ ID NO: 435290 - DNA, 573 bp, Homo sapiens
  misc_feature: GZ8MTXP02JS6G1.44.75.G09.1.454.CMB.2.raw
  modified_base (264)..(264): a, c, t, g, unknown or other
  modified_base (347)..(347): a, c, t, g, unknown or other
tcagacagtatatacacgaccggtgctcgatttagtatagacatcagggacttagggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctgatcacttgaagngtggagtcccagccaggttcagcggcagtggttctggggacacatttcactctcaccatcagcagccctgccagcctggagtntttcgctactttattactgacctaaacaattacttacttttttatacccgttacgtagttttcgggcccgtaagggggtaccaagtcgtagggagtaacgtactaaagggaccttaggtacgggtactggaccaccactccgttagttcttctacttccttccccgcctactaccgtgactataatactcggttactggtaagcggcgttcggacacggtcgctag

SEQ ID NO: 435291 - DNA, 613 bp, Homo sapiens
  misc_feature: GZ8MTXP02FORQJ.44.75.G09.1.454.CMB.2.raw
  modified_base (253)..(253): a, c, t, g, unknown or other
  modified_base (265)..(265): a, c, t, g, unknown or other
  modified_base (306)..(306): a, c, t, g, unknown or other
  modified_base (325)..(325): a, c, t, g, unknown or other
  modified_base (388)..(388): a, c, t, g, unknown or other
  modified_base (481)..(481): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactacttaggaccttttttggcctggtttcagcaggagcctggcaaagcccctaagtccctgattctttnggattcactttnagagtgagtcccagccaggttcagcgtcagtgtctgggacnctatttcactcgtcaaccntaccgagcagtcctaggccaacgcctaggagtactttcgcgtacttagtactacggacctaanaacttactttactttttaactccggttaatacgttttgaccgtaaggggacccagtacgtagagacgtacgaaaggtaaacctggtaccggtntacgacgacctagttcgtcgttacttacgtacttaccgtacccgtactacgttacgtacgttacttacttaacgttacgttcgttacgtaggtaacggtcgggtacgtacggacggaacggtcgaacgtaag

SEQ ID NO: 435292 - DNA, 554 bp, Homo sapiens
  misc_feature: GZ8MTXP02HKXCJ.44.75.G09.1.454.CMB.2.raw
  modified_base (279)..(279): a, c, t, g, unknown or other
  modified_base (307)..(307): a, c, t, g, unknown or other
  modified_base (322)..(322): a, c, t, g, unknown or other
  modified_base (337)..(337): a, c, t, g, unknown or other
  modified_base (341)..(341): a, c, t, g, unknown or other
  modified_base (343)..(343): a, c, t, g, unknown or other
  modified_base (346)..(346): a, c, t, g, unknown or other
  modified_base (351)..(351): a, c, t, g, unknown or other
  modified_base (361)..(361): a, c, t, g, unknown or other
  modified_base (369)..(369): a, c, t, g, unknown or other
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcaggagcctggacaaacgcccctaagtccctgtattcttttctggactcctaagtttgaagagngagtcccagccagtcagcgcagtggtcnggacatattcactcncaccatcagcagctncacncnganttcgntacttatacngaccaaanattattcttttactcgtactagtttgcgtagggaccaagctagagataacgaaaggtactaggtgtcgacgtacacctagtactcggttcttacgacttccttcccgactacgtactgtaactattacgtacttcgttcctaggtaacggtacgggtcggtacggacgtaacgggcgtacgtaag

SEQ ID NO: 435293 - DNA, 573 bp, Homo sapiens
  misc_feature: GZ8MTXP01AE8V8.25.53.E09.1.454.CMB.2.raw
  modified_base (328)..(328): a, c, t, g, unknown or other
  modified_base (364)..(364): a, c, t, g, unknown or other
  modified_base (419)..(419): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaccaacagaagcctggccaggctcccaggctcctcatctatgatacttccagtagggccactggcatcccagcccgnttcagtggcagtgggtcctggggacaggagtttacnctcaaccatcctccagcctagacgccctgaagtattttgctagtttattaccgtntactcgccgtacagaagtacggtccgtctaactaattactacttaccgttcccgtaccggtaccggtaaacgtaggtacgtaatactaaacgaaacgttagtacggttcgtcgtcaccgacttctaacgttctctactcttccctccgctaacg

SEQ ID NO: 435294 - DNA, 526 bp, Homo sapiens
  misc_feature: GZ8MTXP01D7QRP.25.53.E09.1.454.CMB.2.raw
  modified_base (291)..(291): a, c, t, g, unknown or other
  modified_base (331)..(331): a, c, t, g, unknown or other
  modified_base (364)..(364): a, c, t, g, unknown or other
  modified_base (371)..(371): a, c, t, g, unknown or other
  modified_base (374)..(374): a, c, t, g, unknown or other
  modified_base (377)..(377): a, c, t, g, unknown or other
  modified_base (383)..(383): a, c, t, g, unknown or other
  modified_base (392)..(392): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctccagtttcagattccagcggcgaaactgtgttgacacagtctccagccacctgtctttgtctccgggggaacagccaccctctcctgcagggccgcagactgttgacaacgacttagcctggtaccaacagaagcctggccaggctcccaggctcctnatctatgatacttccagtaggccatggcatcccagcccgnttcagtgccagtgggtctgggacaagagtttcnctacacntcncanctagcnctagaagtntttgacttagtttatactgtcagctcgacgaagagtcgtactactactactactacttcgtccgtacggacgaagtaagtagttatacaaacgtaacgtagttcgcgttcgcactaactctcgttcttcttctc

SEQ ID NO: 435295 - DNA, 525 bp, Homo sapiens
  misc_feature: GZ8MTXP01AKXGB.25.53.E09.1.454.CMB.2.raw
  modified_base (338)..(338): a, c, t, g, unknown or other
  modified_base (373)..(373): a, c, t, g, unknown or other
  modified_base (417)..(417): a, c, t, g, unknown or other
  modified_base (452)..(452): a, c, t, g, unknown or other
  modified_base (509)..(509): a, c, t, g, unknown or other
  modified_base (513)..(513): a, c, t, g, unknown or other
  modified_base (520)..(520): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccggccagactgttgacaacgacttagcctggtaccaacagaagcctggccaggctcccaggcctcctcatctatgatacttcagtacggccatggcatcccagccccgnttcaggtgccaggtgggtctgggacagtagtttcnctcacatctccagccctagacgcctagaatattttgctagtttntactgttcagtctccgagaagagtcgacctcaatntctacttccggcctggaaccaagtcgattactacaacggtactgttggcttgcactntctnttcttcnttccc

SEQ ID NO: 435296 - DNA, 630 bp, Homo sapiens
  misc_feature: GZ8MTXP01DRBQ6.25.53.E09.1.454.CMB.2.raw
  modified_base (335)..(335): a, c, t, g, unknown or other
  modified_base (371)..(371): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccgggggaacagccaccctctcctgcagggccgccagactgttgacaacgacttagcctggtaccaacagaagcctggccaggctcccaggctcctcatctatgatactccagtaggccatggcatcccagcccgnttcagtgccaggtggtctggggacaagtagtttccnctacacctatcctccagtcctagacgtctagaagttatttgactttaagttttaacttacgtgtacacgtcctaccgacgaaaggtaacggtcgtaccctaactaattacgttaccgttaccgtttccggtacccgtaacgggtaaaccctaaaggtaacgtaaacttaaacgtaaaccgaaaacggtaacgttcggttacggttccttacgaaccctaacctaattccgttacgttcctttaaccgttaacgttcccc

SEQ ID NO: 435297 - DNA, 537 bp, Homo sapiens
  misc_feature: GZ8MTXP01AXLCH.25.53.E09.1.454.CMB.2.raw
  modified_base (329)..(329): a, c, t, g, unknown or other
  modified_base (356)..(356): a, c, t, g, unknown or other
  modified_base (362)..(362): a, c, t, g, unknown or other
  modified_base (368)..(368): a, c, t, g, unknown or other
  modified_base (371)..(371): a, c, t, g, unknown or other
  modified_base (379)..(379): a, c, t, g, unknown or other
  modified_base (387)..(387): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctcccagtttcagattccagcggcgaaactgtgttgacacagtctccagccacctgtctttgtctccggggaacagccacctctcctgcagggccgcagactgtgacaacgacttagcctggtaccaacagaagcctggccaggctcccaggctcctcatctatgatacttccagtaggccatggcatcccagcccgnttcagtggccaggtggctgggacaagngtttcnctcacntcncagctagnctagaatntttgacttagtttatactgtcagtcctcgacgaaaggtagtcgacctacaattacttcctacgtttccggtcccgtagggaaccaaaggtcggaattactacgaaacgactggttcggcttcgaacactaatctcgttacttcgcttccg

SEQ ID NO: 435298 - DNA, 573 bp, Homo sapiens
  misc_feature: GZ8MTXP01EOD24.25.53.E09.1.454.CMB.2.raw
  modified_base (200)..(200): a, c, t, g, unknown or other
  modified_base (335)..(335): a, c, t, g, unknown or other
  modified_base (379)..(379): a, c, t, g, unknown or other
  modified_base (388)..(388): a, c, t, g, unknown or other
  modified_base (543)..(543): a, c, t, g, unknown or other
  modified_base (549)..(549): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccggggaacgnccaccctctcctgcagggccgccagctgttgacaacgacttagcctggtaccaacagaagcctgtccaggctcccaggctcctcatctatgatacttccagtagggccactgcatccccagcccgcttcagtgcnccggtaggggtccctggggactagtagtttactctcaaccatcncacgctagncctgtaagtatttgtctagttattactgtctagctaccgacaagacgtcggggccttcaaattcttacctaccgttttccgggaccccgttaggggaccctaaaaggtcggaacttaagtaaccaaaacgttaacgtgttggcctgccgttaccncttctnttcttctcttcctcccgttctaag

SEQ ID NO: 435299 - DNA, 530 bp, Homo sapiens
  misc_feature: GZ8MTXP01DX3BS.25.53.E09.1.454.CMB.2.raw
  modified_base (211)..(211): a, c, t, g, unknown or other
  modified_base (345)..(345): a, c, t, g, unknown or other
  modified_base (421)..(421): a, c, t, g, unknown or other
  modified_base (462)..(462): a, c, t, g, unknown or other
  modified_base (482)..(482): a, c, t, g, unknown or other
  modified_base (509)..(509): a, c, t, g, unknown or other
tcagactgtacagtcacgaccggtgctcgatttagagagagtgtgttgggtttgggaggcgtggtccagcctgggaggtccctgagactctcctgtgaagcctctggattttagtttcagtggttctggcatgcactgggtccgccaggctccaggcaaggggccggagtggttggcagttatagcacatgatggaagttctgaatattangcagactcgtgaaggccattcacatctccagagacaatccggaacattgtgtactggaaatggtcagcctgagagtcgaggactcggctctgtattactgtgcgagatcgggaggtggtagtagttattacggngcatgactgggggccaggggaccctgggtccacgtctcctcagcctccacaacgggcccatccggtccttccccgnggccgccctgacctccgaggacgccacctcgagacgcacgngtccggccctggggctgccnggtcaaagggctacttccattgtaacngtctgagcgggtcttgggaac

SEQ ID NO: 435300 - DNA, 546 bp, Homo sapiens
  misc_feature: GZ8MTXP01DMW7D.25.53.E09.1.454.CMB.2.raw
  modified_base (293)..(293): a, c, t, g, unknown or other
  modified_base (332)..(332): a, c, t, g, unknown or other
  modified_base (367)..(367): a, c, t, g, unknown or other
  modified_base (423)..(423): a, c, t, g, unknown or other
  modified_base (428)..(428): a, c, t, g, unknown or other
  modified_base (523)..(523): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacagcccaccctctcctgcgacgggccggccagactgttgacaacgacttagcctggtaaccaacagaacgcctggccaggctcccaggctcctnatctatgatacttccagtggccatggcatcccagcccgnttcagtgcagtcgggtcctgggacagtagtttacnctcaaccatcctccagcctagacgcctagagtatttgctagtttatactgcacgcnccganaagaagtcggggcctacaattacttctacttccggcctagggaacctaaagtgataactaacaaaacgactggttacggctcgcttacattcctntcttcacttcctttcccgctaac

SEQ ID NO: 435301 - DNA, 533 bp, Homo sapiens
  misc_feature: GZ8MTXP01DE56O.25.53.E09.1.454.CMB.2.raw
  modified_base (209)..(209): a, c, t, g, unknown or other
  modified_base (270)..(270): a, c, t, g, unknown or other
  modified_base (298)..(298): a, c, t, g, unknown or other
  modified_base (342)..(342): a, c, t, g, unknown or other
  modified_base (380)..(380): a, c, t, g, unknown or other
  modified_base (464)..(464): a, c, t, g, unknown or other
  modified_base (518)..(518): a, c, t, g, unknown or other
  modified_base (522)..(522): a, c, t, g, unknown or other
  modified_base (528)..(528): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacngccaccctctcctgcagggccggccagactgttgacaacgacttagcctaggtacccaaanagaagcctggccaggctcccaggctccncatctatgatcttccagtacggccactggcatccccagcccgtnttcagtcggccaggtgggtctgggactaagtagtttcnctcaccatcctcaagcctagacgcctagaagtattttagactagtttattactgttccagctccgagaaacgagtcgctacatntcactttcgccctagggaccaagtgattactacaaacgtatgttgcttgcactntctnttctcnctccg

SEQ ID NO: 435302 - DNA, 587 bp, Homo sapiens
  misc_feature: GZ8MTXP01C2EFD.25.53.E09.1.454.CMB.2.raw
  modified_base (338)..(338): a, c, t, g, unknown or other
  modified_base (376)..(376): a, c, t, g, unknown or other
  modified_base (397)..(397): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccggccagactgttgacaacgacttagcctggtaccaaacagaacgctggccaggctcccaggctcctcatctatgatacttccagtagggccatggcatcccagcccgnttcagtcggccaggtgggtctggggacaagtagtttcnctcaccatcctcagccctagngcctgaagtatttgacttagtttatactgtcagcctccgagaacgtaagtcggaccctaccaaattacttctaaccgtttccggacccgttagggaaccctaaaaggtcgggaattaacgtaacaaacgtaaacgtcggttacggcttcgaactaaccctaattctcgtttcttccgttaactttccccg

SEQ ID NO: 435303 - DNA, 593 bp, Homo sapiens
  misc_feature: GZ8MTXP01DZ16I.25.53.E09.1.454.CMB.2.raw
  modified_base (328)..(328): a, c, t, g, unknown or other
  modified_base (364)..(364): a, c, t, g, unknown or other
  modified_base (396)..(396): a, c, t, g, unknown or other
  modified_base (416)..(416): a, c, t, g, unknown or other
  modified_base (420)..(420): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccggggaacagccaccctctcctgcagggccggccagactgttgacaacgacttagcctggtaccaacagaagcctggccaggctcccaggctcctcatctatgatacttccagtaggccatggcatcccagccccgnttcagtggcagtgggtcctggggacagtagtttacnctcaaccatcctccagcctagagcctgaagtnttttgctagtttattacgtntacncgtccgaccgaagaaagtacggtaccgtaccctaacttaacttctaccgttaccgttcccgtaccggtaacggtaaaccgtagggtagtaacttaacaaaacgtaaacgttacgtggttcgtacgccaccgttcttactcttcttcttactccttcccgtcccgaacgttccg

SEQ ID NO: 435304 - DNA, 517 bp, Homo sapiens
  misc_feature: GZ8MTXP01BZC9O.25.53.E09.1.454.CMB.2.raw
  modified_base (335)..(335): a, c, t, g, unknown or other
  modified_base (371)..(371): a, c, t, g, unknown or other
  modified_base (401)..(401): a, c, t, g, unknown or other
  modified_base (445)..(445): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtaggccatggcatcccagcccgnttcagtggccaggtgggtctggggacaagagtttcnctcaccatctcagccctagagcctgaagtnttttgctagtttatactgtcagctccgacaagagtgcctcaatnttcacttcgcctgggaccaagtggattatacaaacgaactgttggcttgcaccaatctgttcttcaattccc

SEQ ID NO: 435305 - DNA, 547 bp, Homo sapiens
  misc_feature: GZ8MTXP01DHSV0.25.53.E09.1.454.CMB.2.raw
  modified_base (331)..(331): a, c, t, g, unknown or other
  modified_base (359)..(359): a, c, t, g, unknown or other
  modified_base (369)..(369): a, c, t, g, unknown or other
  modified_base (373)..(373): a, c, t, g, unknown or other
  modified_base (388)..(388): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccggggaacagccaccctctcctgcagggccggccagactgttgacaacgacttagcctggtaccaacagaagcctgtccaggcctcccaggctcctcatctatgatacttccagtagggccagtggcatcccagccccgnttcagtggcaggtcgggtcctggggacngtagtttacnctcncatctccagcctagngcctgaagtatttgctagtttatactgtcagctcgcaagaagtcgggcctacaattacttctacgtttccggcccttagggaacctaaagtggattactaactaaacgaacgtggttcggctgaccacacttctgtcttcattccgttaacccgctaac

SEQ ID NO: 435306 - DNA, 625 bp, Homo sapiens
  misc_feature: GZ8MTXP01EAZ6Z.25.53.E09.1.454.CMB.2.raw
  modified_base (330)..(330): a, c, t, g, unknown or other
  modified_base (365)..(365): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacagccaccctctcctgcagggccggccagactgttgacaacgacttagcctggtaccaacagaagcctggccaggctcccaggctcctcatctatgatacttccagtagggccactggcatcccagcccgnttcagtggcaggtggtcctgggacagtagtttacnctcaaccatcctccagcctagatcctgaagtatttgctagtttattactgtacagctccgacaaagaacgtcggggacccttacctaaattactttacctaaccgttttcccgggacccgttacgggggtaaccctaaaagggttacgggtaattaacttaaaccgaaaaacgttaaaccgtaggttcgggacttacggaccgaacccttaagttccgttacgttcctttaccactttcccttcccccgttcgttaaccg

SEQ ID NO: 435307 - DNA, 784 bp, Homo sapiens
  misc_feature: GZ8MTXP01CM87A.25.53.E09.1.454.CMB.2.raw
  modified_base (394)..(394): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccacctgtctttgcgtccggggaacagccaccctctcctgcgagggccggccagtactgttgacaacgacttagcctggtaccaacagaagcctggccaggctccaggctcctcatctatgactacttccgagtacgggccagtcggcactcccacgtcccgcttcaggtggccctagggtcggtcgtaggggacctaaggttacgtttcccnctaccacctctcctacgacgtaccgtaacggacgtaccgttaaggtaaacgtttacgttttacgtaacgttttaaggttttaactttacgtacggttaccgtacggttacccgttaccgggaaaccgggtaaaacggggttaaccgggttacccggtaacccctttaaacccgttaaaacgtttacccgtttacccgtttaacccggtttacccggggtaaccccgggttaaacggggtaaaacccgtaaaaggggttaacggtaaacgttaaaccgtaaacccgttaaaaccggttaacggttcgggttaccgggttaccttaccggtaaccctaaccgttaacgtttccgtttacgttaccctttaacccgttaacccgttttccccg

SEQ ID NO: 435308 - DNA, 634 bp, Homo sapiens
  misc_feature: GZ8MTXP01C41SJ.25.53.E09.1.454.CMB.2.raw
  modified_base (338)..(338): a, c, t, g, unknown or other
  modified_base (363)..(363): a, c, t, g, unknown or other
  modified_base (374)..(374): a, c, t, g, unknown or other
  modified_base (378)..(378): a, c, t, g, unknown or other
  modified_base (407)..(407): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacgagcccaccctctcctgcacgggccgccagactgttgacaacgacttagcctaggtaaccaacagaacgcctggcccaggcctcccaggctcctcatctatgatacttccagtagggccactggcactcccagcccgntcagtggcagtgggtcctggggacngtacgtttacnctcncatcctccacgcctagacgcctagaagtntttgctagttttatactgtcagtctcgacaagtaagtcggggtaccctacctaattacttacctaaccgtttccgggaccccgttaagggggaaaccctaaaagggttacgggaaattaaacgttaacccgaaaaacggttaaaccgttggttacggggtaccttcggacccgttacccttagttccttacgttccctttacactttcccttaaccccggccttaac

SEQ ID NO: 435309 - DNA, 656 bp, Homo sapiens
  misc_feature: GZ8MTXP01CT5SF.25.53.E09.1.454.CMB.2.raw
  modified_base (338)..(338): a, c, t, g, unknown or other
  modified_base (385)..(385): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacacgccaccctctcctgcagggccgccagactgttgacaacgacttagcctggtaaccaacagaacgcctggccaggctcccaggctcctcatctatgatacttcagtacggccagtggccaactccccacgccccgtnttcgagtcggcagggttgggtccctaggggactagtacgttttaccncccttacaacctatcctacccgagtcccgtagacgtccctagtaagttattttagacttaagtttattactcgtacacgccttacgacaaggtaacgtcggggtacccttactaaacttactttacccgtaaccgtttcccgggtaccccgttaagggggtaaaccctaaagggttaggtaaacttacgtaaaccggtaaaacgttaacgttcgggaggtacctcggaccttccgttattctacgttctctaccttcctccccgcttaacg

SEQ ID NO: 435310 - DNA, 528 bp, Homo sapiens
  misc_feature: GZ8MTXP01EHSXM.25.53.E09.1.454.CMB.2.raw
  modified_base (330)..(330): a, c, t, g, unknown or other
  modified_base (365)..(365): a, c, t, g, unknown or other
  modified_base (369)..(369): a, c, t, g, unknown or other
  modified_base (479)..(479): a, c, t, g, unknown or other
  modified_base (499)..(499): a, c, t, g, unknown or other
  modified_base (512)..(512): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtagggccactggcatcccagccccgnttcagtgcaggtggtctggggacagtagtttaccnctcncctatccgtccagccctagacgtcctagaagtatttgctagtttattactgtcagctcgacaagagtgggcctacaatctctacttcggcctagggacctaaagtgatanaacaaagactgttggctgcncatctattctacncttccttcccgctaac

SEQ ID NO: 435311 - DNA, 607 bp, Homo sapiens
  misc_feature: GZ8MTXP01EX9TZ.25.53.E09.1.454.CMB.2.raw
  modified_base (261)..(261): a, c, t, g, unknown or other
  modified_base (342)..(342): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacagcccaccctctcctgcagggccggccagactgttgacaacgacttagcctggtaaccaanagaagcctgtccaggcctcccaggcctcctcatctatgattaccttccaggtacgggccacgtggcactccccagccccgnttcagtggcaggtgggtcctggggacaggtactttacctctcaacctatcctccagtccctaagacgtcctagaagtatttgctagtttattactgtcagctccgacaagaagtcggggcctacctaattacttcctaccgtttccggacccgttacgggaacctaaaggtcggtaataagtaacaaacgttaacgtggttcggtcgtacgaccttaccttacttccttacgttccttactacttcccttccccgaaccttaacg

SEQ ID NO: 435312 - DNA, 670 bp, Homo sapiens
  misc_feature: GZ8MTXP01BC73S.25.53.E09.1.454.CMB.2.raw
  modified_base (403)..(403): a, c, t, g, unknown or other
  modified_base (418)..(418): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgttctttgtcgtccgggggaacgagcccaccctctcctgcgagggccgccagactgttgacaacgacttagcctaggtaacccaacagaacgcctggccaggcctcccgaggcctcctcatctatgactacttccaggtacggccagtcggcactcccacgccccgtcttcgaggtggccgagggttgggtcgtggggactaaggtacgtttccnctacaccctattccnccacgtccctaggactccgtagtaagttattttgactttagttttatactgtcagtcgttacccgagtaaaggtaacggtccgtaccttactaacttcgttacctaaccggttttcccggacccggttacgggaaacccgttaaagggtcggtaaatttaacctaaaccgaaaacggtaaccgttgggttacggcttacggaaccctaccctaatttcctcggtttcctttaaccgttaaccgtttcccccg

SEQ ID NO: 435313 - DNA, 613 bp, Homo sapiens
  misc_feature: GZ8MTXP01ESRPZ.25.53.E09.1.454.CMB.2.raw
  modified_base (385)..(385): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgttctttgtccgtccgggggaacagcccacctctcctgcagggccgcagactgttgacaacgacttagcctggtaacccaacagaacgcctggccaggcctcccaggctcctcatctatgatacttccaggtacggccagtggcactcccagccccgcttcgagtggccaggtgggtctggggacaagtacgtttcnctacacctatcctccacgtcctagacgcctagaagttatttgacttagttttactactgtcagtcctccgacgaaggtaagttcgaccctactaaattcttactaccgtttccggcccgtacggggtaaccctaaaggtcggtaaattacgaaccgttaaacgtaacgtggttacgggttcttacggaacctaacccttcttcgttcgttacctttccttccgtcccg

SEQ ID NO: 435314 - DNA, 751 bp, Homo sapiens
  misc_feature: GZ8MTXP01AFBBR.25.53.E09.1.454.CMB.2.raw
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccggggaacagccacctctcctgcagggccgcagactgtgacaacgacttagcctggtaccaacagaacgcctggccaggcctcccgaggcctcctcatctatgatacttcgagtacggccacgtggcactccccagcccgcttcgaggtcggccaggtggggtctagggggactaaggttacgttttctcgttccaacctacttccctccgaacgtacccttaacggacgtcccgttaggtaaacggttatttttacggacgtttaacggtttttactttaaccgttcgttacctaacggtccgttacccggaacgtaaacgggtaaacggttccgggtacccctttaaccgtaaacgtttactttacccgttaaacccggtttttcccgggaccccgtttaacgggggaaacccttaaaaggggttaacggtaaacgtttaaacgtaaacccgttaaaacggttaaaccgttcgggttacggccgttacggaaccctaacccgtaactttccgttacggtttccctttaaccgttaacccgtttcccccg

SEQ ID NO: 435315 - DNA, 604 bp, Homo sapiens
  misc_feature: GZ8MTXP01ERC90.25.53.E09.1.454.CMB.2.raw
  modified_base (583)..(583): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagcccaccctgtctttgtcgtccgggggaacgagcccaccctctcctgcagggccgccagactgttgacaacgacttagcctaggtaccaacagaacgcctggccaggcctcccgaggcctcctcatctatgatacttccaggtacggccactggcactcccacgccctcttcgaggtcggaccctaggtggggtccgtgggaactaaggtacgttttaacctctaccaccctatcctcccgagtcctaggagcctaggaatatttgactagttttatacttgcagtcctaccgagaagtaagtcgacctactaatacttcaccgtttccggcccttagggaacctaaaggtcggtaattacaacgttaaacgacgtgttacggcttcggaacctactaatctnttccttcgttaactttccccg

SEQ ID NO: 435316 - DNA, 780 bp, Homo sapiens
  misc_feature: GZ8MTXP01AQV34.25.53.E09.1.454.CMB.2.raw
  modified_base (401)..(401): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccgggggaacgacgccaccctctcctgcagggccgcagactgtgacaacgacttagcctggtaaccaacagaacgcctggccaggcctcccgaggcctcctcatctatgatactccagtacggccacgtcggcactcccgacgcccgtcttacgaggtcggccgtagggtcgggtccgtaggggactaaggtacgttttccnctaccaccctactccgtacccgacgtacccctaggaccgtccgttaaggtaaacgtttacgtttttacggaaccgtttaaaggtttttaaacctttaaccgttcgggttacccaaacgggttcccctttaaccccggggaaccggtaaaaagggttaaacggggttcccgggtaacccccgtttaaaccgtaaacgtttaaccttttacccgttaaacccggtttttcccgggacccccggtttaagggggaaaaccctaaagggttcggtaaacttaacgtaaacccgaaaaacggtaaccgttggttacgggttccttacggaaccctaaccgttaacttccggttacgttccctttaacgttaaccttttccccgg

SEQ ID NO: 435317 - DNA, 531 bp, Homo sapiens
  misc_feature: GZ8MTXP01BKX0E.25.53.E09.1.454.CMB.2.raw
  modified_base (376)..(376): a, c, t, g, unknown or other
  modified_base (397)..(397): a, c, t, g, unknown or other
  modified_base (422)..(422): a, c, t, g, unknown or other
  modified_base (499)..(499): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccacctctcctgcagggccggccagactgttgacaacgacttagcctggtaaccaacagaagcctggcccaggcctcccaggctcctcatctatgatactcagtacggccatggcactcccagcccgtcttcagtggccaggtgggtctggggacaagtacgtttcnctcaccatcctcagcctagancctgaatatttgctaagtttatacngtcagctccgagaagtagtcgacctacaattctctacgtttcgaccgtgggaccaagtggattatacaaacgtatgnggcttgccactaatcgtcttctcaacgttccc

SEQ ID NO: 435318 - DNA, 589 bp, Homo sapiens
  misc_feature: GZ8MTXP01CLO76.25.53.E09.1.454.CMB.2.raw
  modified_base (265)..(265): a, c, t, g, unknown or other
  modified_base (342)..(342): a, c, t, g, unknown or other
  modified_base (374)..(374): a, c, t, g, unknown or other
  modified_base (380)..(380): a, c, t, g, unknown or other
  modified_base (383)..(383): a, c, t, g, unknown or other
  modified_base (386)..(386): a, c, t, g, unknown or other
  modified_base (391)..(391): a, c, t, g, unknown or other
  modified_base (399)..(399): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagtggcgaaactgtgttgacacagtctccagccaccctgtctttgctccgggggaacagccaccctctcctgcagggccgccagactgtgacaacgactagcctaggtaaccaanagaacgcctggccaggcctcccaggcctcctcatctatgatacttccagtacggccactggcactccccagccccgnttcagtgccaggtggtctgggacaagtattcnctcacntcncanctagnctagagtntttgacttagtttatacgtgtacagtcctaccgagaaacgtaaggtcgaccctacaaattacttctaaccgtttccggacccttagggaaacccaaaggttcggaaattacgaaccgaaacgtaaaccgtgttcgggccttacgtaaccaacccttgttccgttacgttaccttaaccgttcgtttcccg

SEQ ID NO: 435319 - DNA, 806 bp, Homo sapiens
  misc_feature: GZ8MTXP01BXB5O.25.53.E09.1.454.CMB.2.raw
tcagactgtacagtcacgaccggtgctcgatttagagagagtgtgttgggtttgggggaggaactgctcagttaggacccagagggaacaatggaagccccagctcagcttctcttcctcctgctactctggctcccagtttcagattccagcggcgaaactgtgttgacacagtctccagccaccctgtctttgtcgtccgggggaacgagccaccctctcctgcgagggccggccagactgttgacaacgacttagcctggtaccaacagaacgcctggccaggcctcccgaggcctcctcatctatgatacttccagtacgggccacgtggcactccccacgccccgcttcgaggtcggccagggttcggggtcgtgggggactaaggtagttttaacctctaccacctacttcctaccgacgtcccttaaggacgtccgttaggtaaacgttagtttttacggtaccgtttaaggttttttaactttaaccgttcgggttaccctaacggttccccgtttaccccgggaaacggtaaaacggggttaaacgggttcccggggtaaccccctttaacccgtaaaactttaccgttttacccgttaaaccccggttttttccccgggggaacccccggtttaacggggggtaaacccctaaaaggggttaacgggtaaactttaaaccgtaaaccggttaaaaccggtaaaccgttgggttaacggggttccttacgggaaccctaacccgttaactttccggttacgtttacccttttaacccgttaaccgtttttccccccg

SEQ ID NO: 435320 - DNA, 857 bp, Homo sapiens
  misc_feature: GZ8MTXP01DKQUS.25.53.E09.1.454.CMB.2.raw
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccgggggaacgagccacctctcctgcagggccgccagactgttgacaacgacttagcctaggtaaccaacagaacgccgtggccaggcctcccaggctcctcatctatgatactccagtacggccacgtggcactcccacgtccccgtctttaccgaggttcggaccccgtaggggtttcgggggtaccgttacggggggaactaaacgggttaacggtttttaaccctcccgttacccgtaaacccctacttcccccgttaccccgaaacgggtacccccgttaaagggtaccgggtacccctttaagggtaaaacggtttagtttttttacgggtacctttaaagggtttttttaactttaaccgtttacgggttaccaacggttacccgttaccccggaaacgggttaaaacggtaaacgggttccgggtaaccccgtttaacctaaaactttaacctttaccgttaaacccgtttttccccggggaccccggttaacgggggtaaaaccccgtaaaaggttaacgggttaaacttaaacgtaaacccgttaaaaacggggttaaacccttggggttaacggttccgtttacggaaccctaacccgttaacgtttccccttaggtttccctttaaccgttaacccgtttcccccg

SEQ ID NO: 435321 - DNA, 545 bp, Homo sapiens
  misc_feature: GZ8MTXP01ANXXE.25.53.E09.1.454.CMB.2.raw
  modified_base (257)..(257): a, c, t, g, unknown or other
  modified_base (262)..(262): a, c, t, g, unknown or other
  modified_base (328)..(328): a, c, t, g, unknown or other
  modified_base (331)..(331): a, c, t, g, unknown or other
  modified_base (346)..(346): a, c, t, g, unknown or other
  modified_base (350)..(350): a, c, t, g, unknown or other
  modified_base (358)..(358): a, c, t, g, unknown or other
  modified_base (362)..(362): a, c, t, g, unknown or other
  modified_base (379)..(379): a, c, t, g, unknown or other
  modified_base (475)..(475): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgctccgggggaacagccaccctctcctgcagggccggccagactgttgacaacgacttagcctggtaccaanagaancctggcccaggctcccaggctctcatctatgatacttccagtacggccatggcatcccagcccctntcngtgctaggtggtccngganagtattcncacnctatctacagctagacnctagattattgattagttatactgtcacgctacgagaagtagtcggcctactaatacttccgtacgttccgaccgtaggaacctaagtagactaanaacgtaaacgttacgtgttcgtctacgacgttaccttattcgtcttccttactccttccctcccgctaag

SEQ ID NO: 435322 - DNA, 518 bp, Homo sapiens
  misc_feature: GZ8MTXP01EX0TK.25.53.E09.1.454.CMB.2.raw
  modified_base (271)..(271): a, c, t, g, unknown or other
  modified_base (291)..(291): a, c, t, g, unknown or other
  modified_base (295)..(295): a, c, t, g, unknown or other
  modified_base (320)..(320): a, c, t, g, unknown or other
  modified_base (334)..(334): a, c, t, g, unknown or other
  modified_base (386)..(386): a, c, t, g, unknown or other
  modified_base (397)..(397): a, c, t, g, unknown or other
  modified_base (412)..(412): a, c, t, g, unknown or other
  modified_base (415)..(415): a, c, t, g, unknown or other
  modified_base (491)..(491): a, c, t, g, unknown or other
  modified_base (493)..(493): a, c, t, g, unknown or other
  modified_base (508)..(508): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccgccagactgttgacaacgacttagcctggtaccaaacagaancctggccaggctcccaggcncctnatcatgatactcagtaggccatggnatcccagccgcttnagtgccagtgggtcgtggacgaagagttaactctcaccatctcacgccaganctagagtattntatattattactgtnacnctcgacgaagaagtagactactaatatactacttcgtccgtacgacgaagtaagtaattatacaaacgaaactagngngttcgcacaactctnttctcttctc

SEQ ID NO: 435323 - DNA, 715 bp, Homo sapiens
  misc_feature: GZ8MTXP01BCYHD.25.53.E09.1.454.CMB.2.raw
  modified_base (246)..(246): a, c, t, g, unknown or other
  modified_base (347)..(347): a, c, t, g, unknown or other
  modified_base (393)..(393): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagcccaccctgtctttgtccgtccgggggaacgagccaccctctcctgcgagggccgccagactgtnacaacgacttagcctaggtaccaacagaacgcctggcccaggcctcccaggcctcctcatctatgatcttccaggtacggccacgtggcactcccagcccncttcgagtggcctaggtgggtctggggactaaggtacgttttaacnctaccacctacttcctaccgacgtccgttagacgtcctagtaagttacttttggaactttagttttacttacgtgtaccgtaacgtccgttacccgaacggtaaaggttaaaccggttccggtacccctttaaaccgtaaacgtttacctttaccccgttaaccggtttttccccgggaccccgttaacgggggtaaaccccttaaagggttaacgggtaaacttaaacgttaaaccgaaaacgtaaaccgttgggttaccggttcttaacggtaaccctaaccctttcgttccttcgttaccttaaccgttcccgttcccg

SEQ ID NO: 435324 - DNA, 650 bp, Homo sapiens
  misc_feature: GZ8MTXP01B9HSY.25.53.E09.1.454.CMB.2.raw
  modified_base (351)..(351): a, c, t, g, unknown or other
  modified_base (403)..(403): a, c, t, g, unknown or other
  modified_base (449)..(449): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccacctctcctgcgacgggccgccagactgttgacaacgacttagctaggtaccaaacagacgcctggccacggcctccgaggtcctcctcatcgtatgatacttccgagtacggccatcggctactccccacgccccgtnttaccgaggtcggaccctgggtggtccgttagggactaaggtacgttttccnctaccacctacgtcctaccagccctagacgtcctaggaattatttnacgttagttttatacctgttcacgtacctaccgacgtaaagtaacggtcggtacctacctaaattctttaccaccgttttcggccccgttaggaaaccgtaaggttaagggaactttaactaacgaaaaccgtaacgttgttacgggttcttacgggaaccctacgtaacttcgtactttccttaacttaacggtttcccc

SEQ ID NO: 435325 - DNA, 651 bp, Homo sapiens
  misc_feature: GZ8MTXP01A2Y0G.25.53.E09.1.454.CMB.2.raw
  modified_base (400)..(400): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccacctgtctttgtcgtccggggaacagccacctctcctgcgagggccgcagactgttgacaacgacttagcctggtaaccaacagaacgcctggccaggcctacccaggcctcctcaactctaatcgactacttccagtacgggccatcggacactcccaggccctcttcgagtcggcccaggtcggggtctagggggactaaagtacgttttaaccncctacctactacgtcctacgacgtcctagacgtacgtagtaagttgtttacgtacgtttagttttaactacgtcgtactacgtaccttaccgaaggtaaacggtacggtaccgtacccttaactaaattccgttaccgttaccgtttccggtaccgttaacgggaaaccgtaaaggtaacgtaacttaacgtaacgaaacgtacggtgttacggcttacgaactactgttcgtcgttccttcttcgttccg

SEQ ID NO: 435326 - DNA, 797 bp, Homo sapiens
  misc_feature: GZ8MTXP01ANJ26.25.53.E09.1.454.CMB.2.raw
  modified_base (209)..(209): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccggggaacngccacctctcctgcgagggccgccagactgttgacaacgacttagcctggtaccaacagaacgccgtggcccaggcctcccaggtcctcctcatctatgatactccaggtacggcacgtggcactcccacgcccgtcttcgagttcggcctaggtgggtacctgggactaagttacgtttaacctctaccacctacttcccgtaccgacgtacccgttaagacgtacccgtagtaaacgtttacgtttttacgtacgtttaaaggtttttaacttaacccgttcgtttaccgaaaccgttccgtttacccgggaaccggtaaaacggtaaaccggggtttccggtaacccctttaacccgtaaaagtttaccctttaccccgtttaacccgggtttttcccgggtaacccccgggtttacgggggaaaaccccttaaaggggttaacgggtaaacctttaaacggtttaaacccgaaaaaaccggtaaccggtttacggttaccggggttcctttacgggaaccccgtaacccttaacgtttcccttacggtttaccgtttaacccgttaacctttttaaccccccgg

SEQ ID NO: 435327 - DNA, 610 bp, Homo sapiens
  misc_feature: GZ8MTXP01BKFUX.25.53.E09.1.454.CMB.2.raw
  modified_base (285)..(285): a, c, t, g, unknown or other
  modified_base (297)..(297): a, c, t, g, unknown or other
tcagactgtacagtcacgaccggtgctcgatttagagagagtgtgttgggtttgggggaggaacttctcagttaggacccagagggaaccatggaagccccagctcagcttctcttcctcctgctactctggcctcccagtttcagattccagcggcgaaactgtgttgacacagtctccagccaccctgtctttgtcgtccgggggaacacgccaccctctcctgcagggccgcagactgttgacaacgacttagcctggtaccaacagaagcctggccaggcncccaggctcctnatctatgatactcagtacgggccagtggcactccccagccccgtacttcgagtcggctaggtggggtactggggactaggtaacgtttacctctccaaccattcctaccgaggtcctaagacgtccgtagtaagtattttgcttaagttttacttactcgtacagcctcgacaagggacgtcgaccctacgaaattcttcctacgtttaccggcccgtcggaacctaaaggttcggtaataacgttactaaaacgttacgtaggtcggacgttgacctaacctatcttcgtcctttactaactttcccgtccc

SEQ ID NO: 435328 - DNA, 610 bp, Homo sapiens
  misc_feature: GZ8MTXP01BFS27.25.53.E09.1.454.CMB.2.raw
  modified_base (298)..(298): a, c, t, g, unknown or other
  modified_base (564)..(564): a, c, t, g, unknown or other
  modified_base (589)..(589): a, c, t, g, unknown or other
tcagactgtacagtcacgaccggtgctcgatttagagagagtgtgttgggtttgggggaggaactgctcagttaggacccagaaggaaccatggaagccccagctcagcttctcttcctcctgctactctggctcccagtttcagattccagcggcgaaactgtgttgacacagtctccagccaccctgtctttgtcgtccggggaacagccaccctctcctgcgacgggccgccagactgttgacaacgtacttagcctggtaccaacagaagcctggccaggcctcccaggctccnatctatgatcttcagtcggcacgtgcactcccagcccgcttcgaggtggccctagggtcggggtcgtcgggggaactaacgggttacttttaacctcccttaccaaccctacttccgttaccgacgtaccctaaggaaccgtaccgtaggtaaacgttagttttcggacttaggtttttaactcgttcgttacacgtcctaccgtaggaaacgtaacgtcgacctactaattactctaccgttcgccgtagaacctaagcgattanacaaacgtactgcgcttacgcactntcgtacttctaacttcgtccc

SEQ ID NO: 435329 - DNA, 704 bp, Homo sapiens
  misc_feature: GZ8MTXP01A0YF4.25.53.E09.1.454.CMB.2.raw
  modified_base (347)..(347): a, c, t, g, unknown or other
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtccggggaacagccaccctctcctgcagggccgccagcgtgtgacaacgacttagcctaggtaaccaacagaagccgtggcccaggcctcccgaggcctcctcatctatgattacttccaggtacgggccacgtggcctactccccgaggccccgtntttccgaggtcggccgtagggttcggggtaccgttacgggggaacaggttaaccgtttaacctccttaccaaccctacgtccctaccgacgtacccgttaagggactacccgtagtaaaagggttttctttacgtactttaagtttacttacgtcgttacacggtaccgtaacgaacgtaaacgggtaacggtccgggtaacccttaacgttaaatttaccgttacccgttaccggtttcccggaaccggttaacgggaaacgtaaaggttacgaactaacgtaaaccgaaacgttgtcggacgtctacgacttaccttcttcgttcgttcttacgtcccttcccgtcccgaacctg

SEQ ID NO: 435330 - DNA, 526 bp, Homo sapiens
  misc_feature: GZ8MTXP02JGFKC.25.53.E09.1.454.CMB.2.raw
  modified_base (338)..(338): a, c, t, g, unknown or other
  modified_base (372)..(372): a, c, t, g, unknown or other
  modified_base (487)..(487): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccggccagactgttgacaacgacttagcctggtaccaacagaagcctggccaggctcccaggctcctcatctatgatacttccagtaggccactggcactcccagccccgnttcagtggccagtgggtctggggacagagtttcnctcaccatcctcagccctagagcctgaagtattttgctagtttattactgtcagtctccgacaagtagtcgcctacaattattcactttcgcccgtagggaccaaagtcgaatanacaaacgactgtacgctagcacatctgtcttcacttccc

SEQ ID NO: 435331 - DNA, 509 bp, Homo sapiens
  misc_feature: GZ8MTXP02GMM3S.25.53.E09.1.454.CMB.2.raw
  modified_base (330)..(330): a, c, t, g, unknown or other
  modified_base (363)..(363): a, c, t, g, unknown or other
  modified_base (439)..(439): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccgcagactgtgacaacgcttagcctggtaccaacagaagcctggccaggctcccaggctcctcatctatgatacttccagtaggccatggcatcccagcccgntcagtggccagtgggtctggggacagagtttcnctcaccatctcagccctagagcctgaagtattttgctagtttatactgtcagtctccgacaagaagtgcctcaatntcactttcgccctggaccaaagtcgatatacaaacgaactgtacgctgctaccatctgtcttacattccc

SEQ ID NO: 435332 - DNA, 529 bp, Homo sapiens
  misc_feature: GZ8MTXP02IR0YT.25.53.E09.1.454.CMB.2.raw
  modified_base (334)..(334): a, c, t, g, unknown or other
  modified_base (519)..(519): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccgccagactgttgacaacgacttagcctggtaccaacagaagcctggccaggctcccaggctcctcatctatgatacttccagtaggccatggcatcccagcccgnttcagtgccagtgggtctgggacagtagtttctctcaccatcctaccagccctagacgcctagaagtattttgactagtttattactgtcagtctccgacaaagagtcggcctaccaattcttactactttcggccttgggaccaaagtcggatatacaaaacgactgtacgctagcaccatctntcttcactcc

SEQ ID NO: 435333 - DNA, 531 bp, Homo sapiens
  misc_feature: GZ8MTXP02FL4EJ.25.53.E09.1.454.CMB.2.raw
  modified_base (376)..(376): a, c, t, g, unknown or other
  modified_base (406)..(406): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtagggccactggcatccccagccccgcttcagtggccaggtgggtctggggacagtagtttcnctcaccatcctcagcctagagcctgaagtnttttgctagtttattactgtacagctccgacaaagaagtcgacctacaacttattctactttccggccctagggaccaaagtggatatacaaacgaactgtcgctagcacatctgtctcattccc

SEQ ID NO: 435334 - DNA, 500 bp, Homo sapiens
  misc_feature: GZ8MTXP02GVNZ8.25.53.E09.1.454.CMB.2.raw
  modified_base (335)..(335): a, c, t, g, unknown or other
  modified_base (370)..(370): a, c, t, g, unknown or other
  modified_base (492)..(492): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccgccagactgttgacaacgacttagcctggtaccaacagaagcctggccaggctcccaggctcctcatctatgatacttccagtaggccactggcatcccagcccgnttcagtggccagtgggtctggggacagagtttacnctcaccatcctcagcctagacgcctgaagtatttgctagtttattactgtacagctcgcaagagtgctcatatcacttcgcctggacaagtgatatacaaacgactgtacgctgcacatctntctcactc

SEQ ID NO: 435335 - DNA, 626 bp, Homo sapiens
  misc_feature: GZ8MTXP02IKJPN.25.53.E09.1.454.CMB.2.raw
  modified_base (336)..(336): a, c, t, g, unknown or other
  modified_base (372)..(372): a, c, t, g, unknown or other
  modified_base (407)..(407): a, c, t, g, unknown or other
  modified_base (441)..(441): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccacctgtctttgtctccggggaacagccaccctctcctgcagggccggccagactgttgacaacgacttagcctggtaccaacagaagcctggccaggctcccaggctcctcatctatgatacttccagtagggccatggcactcccagcccgnttcagtgccaggtggtctggggacaggtagtttccnctcaccctatcctcagccctagacgcctagaagtnttttgactagttttatactgtacagtcctccganaaaggtaagtcggacccttaccaaattctttacctaacgttttccgggaccccgttaggggaaacccctaaaagggttggaaactttaaacgtaccgtaaaaaccggaactttacgggtacgggtaccttacgggaacctaacccgtaatttcccgtaggtttccctttacgtaactttcccccg

SEQ ID NO: 435336 - DNA, 513 bp, Homo sapiens
  misc_feature: GZ8MTXP02FLMEL.25.53.E09.1.454.CMB.2.raw
  modified_base (330)..(330): a, c, t, g, unknown or other
  modified_base (365)..(365): a, c, t, g, unknown or other
  modified_base (369)..(369): a, c, t, g, unknown or other
  modified_base (386)..(386): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaccaacagaagcctggccaggctcccaggctcctcatctatgatacttccagtagggccactggcatccccagccccgnttcagtggcagtgggtcctggggacagagtttacnctcnccatctccagcctagancctgaagtatttgctagtttattactgtcagctccgcaaagagtggcctcaatattcactttcgcctgggaccaaagtgatatacaaaacgaactgtaggctgcaccatctgtctcatctccgctac

SEQ ID NO: 435337 - DNA, 579 bp, Homo sapiens
  misc_feature: GZ8MTXP02I0D8J.25.53.E09.1.454.CMB.2.raw
  modified_base (315)..(315): a, c, t, g, unknown or other
  modified_base (323)..(323): a, c, t, g, unknown or other
  modified_base (356)..(356): a, c, t, g, unknown or other
  modified_base (470)..(470): a, c, t, g, unknown or other
tcagactgtacagtcacgaccggtgctcgatttagagagagtgtgttgggtttggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaagggccattcaccatctcagagacaattcccggaacattgtgtacttggaaatggtcagcctgagagtcgaggactcggctctgtattacngtgcgagngtcggggaggtggtagtagtttattaccggggngcagtcggacgtgggggccagggggaccctgggtcaccggtctcctcacgccctcccaccgaacgggcccctagtccggtccttcccccgtggcccgccctgcctccgaggacnccaccgtccgagacgcacgacggccgcccgtggggcctcggcccgtggtccgacgggaccttaccttcccgacttcggtaacacggttctggacggcggggctgggacg

SEQ ID NO: 435338 - DNA, 558 bp, Homo sapiens
  misc_feature: GZ8MTXP02GY52W.25.53.E09.1.454.CMB.2.raw
  modified_base (336)..(336): a, c, t, g, unknown or other
  modified_base (373)..(373): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccggccagactgttgacaacgacttagcctggtaccaacagaagcctggccaggctccaggctcctcatctatgactacttccagtaggccactggcatcccagccccgnttcaggtgcccaggtcggtctgggacagtagtttccnctcacctatcctacagccctagacgcctgaagtatttgactagtttattactgtacagctccgacaagtagtggcctaccaatacttcaacgtttcggcccttaggggaccctaaaagtcggtaatatacgaaaacgtactggtacggtctacgccaacctattctgttaccttacactttcccc

SEQ ID NO: 435339 - DNA, 599 bp, Homo sapiens
  misc_feature: GZ8MTXP02ILPFN.25.53.E09.1.454.CMB.2.raw
  modified_base (285)..(285): a, c, t, g, unknown or other
  modified_base (327)..(327): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccacctgtctttgtctccggggaacagccaccctctcctgcagggccggccagactgttgacaacgacttagcctggtaccaacagaagcctggccaggctcccaggctcctnatctatgatacttccagtagggccatggcatcccagcccgtnttcagtggcaggtgggtctggggacagtagtttactctacaccatcctccagtccctagacgccctagaagtattttgctagtttattactcgtcagtctaccgacaaaggaagttcggacccttacctaattacttacctaccgttttccgggacccgttacggggtaaaccctaaaggttacgggaattaactaaccgaaaacgtaaacgtggttacgggactcggacctactaactcttcgttcttactacttcctttcccgacctaac

SEQ ID NO: 435340 - DNA, 560 bp, Homo sapiens
  misc_feature: GZ8MTXP02J3SPC.25.53.E09.1.454.CMB.2.raw
  modified_base (181)..(181): a, c, t, g, unknown or other
  modified_base (208)..(208): a, c, t, g, unknown or other
  modified_base (264)..(264): a, c, t, g, unknown or other
  modified_base (313)..(313): a, c, t, g, unknown or other
  modified_base (353)..(353): a, c, t, g, unknown or other
tcagactgtacagtcacgaccggtgctcgatttagagagagtgtgttgggtttgggaggcgtggtccagcctgggaggtccctgagactctcctgtgaagcctctggatttagtttcagtggttctggcatgcactgggtccgccaggctccaggcaaggggccgagtggttggcagttanagcacatgatggaattctgaatattangcagactccgtgaaggccattcaccatcgtccagagacaattcccggaacattgtntacttggaaatggtcagcctgagagtcgaggactcggctctgtattacngtgcgagatcggggaagtggtacgtgttattaccggggcnagtcggacgtggggccgacggggtcctgtccaccgtctccacacgccaccaccgaacggccgacgtccgtcccgttccccgtccggccgcccgtccgccgtccgacggacgaccgacccgaccgacgacgacacgacgccggccgtcggcgtcgcgcgacgaacgactacctacctactacgtaacgacgtcgcgacgcggcgcgcg

SEQ ID NO: 435341 - DNA, 591 bp, Homo sapiens
  misc_feature: GZ8MTXP02J3KV1.25.53.E09.1.454.CMB.2.raw
  modified_base (330)..(330): a, c, t, g, unknown or other
  modified_base (367)..(368): a, c, t, g, unknown or other
  modified_base (374)..(374): a, c, t, g, unknown or other
  modified_base (383)..(383): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttcagtagggccactggcatccccagccccgnttcagtggcagtgggtcctggggacagagtttacctnntcatcncagctagcnctagagtatttgcttagtttacttactgtacacgtcctcgacaagacgtcgacctactaattacttcctaccgtttccggacccgttacggggaacctaaaggtacggtaacttaacgtaaccgaaaacgtaacgttcggtcggtacctacgtaccaaccgtaacttccgttacgttaccttacctactttaccccgttacccgtacc

SEQ ID NO: 435342 - DNA, 554 bp, Homo sapiens
  misc_feature: GZ8MTXP02J11RG.25.53.E09.1.454.CMB.2.raw
  modified_base (335)..(335): a, c, t, g, unknown or other
  modified_base (371)..(371): a, c, t, g, unknown or other
tcagactgtacagtcacgaccggtgctcgatttagagagagtgtgttggggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacgagccaccctctcctgcagggccgccagactgttgacaacgacttagcctggtaccaacagaagcctggccaggctcccaggctcctcatctatgatacttcagtaggccatggcatcccagcccgnttcagtggccagtggggtctggggacagagtttccnctcaccatcctcagcctagacgtcctagaagttatttgcttagtttacttactgtactacgtcctccgacaagtagtcggaccctactaattacttactacgtttccggcccgttagggaaccgtaaaggtcggaatactacgaaacgacgtcgtcgtctcgcacactctcgtcttcactccg

SEQ ID NO: 435343 - DNA, 550 bp, Homo sapiens
  misc_feature: GZ8MTXP02JBS5Y.25.53.E09.1.454.CMB.2.raw
  modified_base (334)..(334): a, c, t, g, unknown or other
  modified_base (374)..(374): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccgccagactgtgacaacgacttagcctggtaccaacagaagcctggccaggctcccaggctcctcatctatgatacttccagtaggccactggcatcccagccccgnttcagtggcccaggtgggtctggggacaggagttttaccnctcacctatcctccagccctagacgccgtagtaagtatttgactagtttattactgtctacgtctccgacaagtaagtcgacctactaattacttactacgtttccggaccgtagggaacctaaaggtcgtatatacaaacgtacgtcgtcgctgaacactactctgtctcactcc

SEQ ID NO: 435344 - DNA, 630 bp, Homo sapiens
  misc_feature: GZ8MTXP02GEXWZ.25.53.E09.1.454.CMB.2.raw
  modified_base (208)..(208): a, c, t, g, unknown or other
  modified_base (375)..(375): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacngccaccctctcctgcagggccggccagactgttgacaacgacttagcctggtaccaacagaagcctggccaggctccaggctcctcatctatgatacttccagtagggccactggcatcccagccccgtcttcaggtggccaggtgggtctggggacagtagtttcnctcacctatcctcagccctagacgtcctagaagtatttgactagtttattactgtacagtctccgacaaaggtaacgtcggaccctaccaaattacttacgtaaccgttttccgggcccccgttaggggaaaccctaaaaggttacgggtaaattaacgtaaccgtaaaaacggtaaaccgttgggttaacggccgttacggaaccgacccgtaaagtttccgtacgtttcctttaaccgtaccttttcccccgg

SEQ ID NO: 435345 - DNA, 622 bp, Homo sapiens
  misc_feature: GZ8MTXP02JBZ8S.25.53.E09.1.454.CMB.2.raw
  modified_base (294)..(294): a, c, t, g, unknown or other
  modified_base (373)..(373): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccgccagactgtgacaacgacttagcctggtaccaacagaagcctggccaggcctcccaggctcctnatctatgatacttccagtaggccatggcatccccagccccgcttcagtggccaggtgggtctggggacaggtagtttcnctcacctatcctaccagccctagacgtcctagaagtattttgacttagtttattactgtacagtctcgacaagaacgtcggacctaccaaattacttacctaaccgttttccggccccgttagggggaaaccctaaaagggttacggtaaacttaacgtaaaccgtaaaaacgtaaaccgttggtacgggtccttacggaaccctaacccgtaacgttccttcgtttacctttaccaacttttcccccg

SEQ ID NO: 435346 - DNA, 561 bp, Homo sapiens
  misc_feature: GZ8MTXP02HVB5U.25.53.E09.1.454.CMB.2.raw
  modified_base (376)..(376): a, c, t, g, unknown or other
  modified_base (401)..(401): a, c, t, g, unknown or other
  modified_base (440)..(440): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccacctctcctgcagggccgccagactgttgacaacgacttagcctggtaccaacagaagcctaggccaggctcccgaggctcctcatctatgatacttccagtaggcactggcatcccagccccgcttcagtggcccaggtcgggtctggggacaggtagtttacnctacaccctatcctcagtccctagncctagaagtatttgctagttttatactgtcagctccganaaagagtcggacctaccaatacttccgactttccggccccgttagggaacctaaaaggtcggaattacaacgaaaacgtaacttgacggtcagcctacattcctgtccttactacttcccg

SEQ ID NO: 435347 - DNA, 551 bp, Homo sapiens
  misc_feature: GZ8MTXP02IZTV8.25.53.E09.1.454.CMB.2.raw
  modified_base (336)..(336): a, c, t, g, unknown or other
  modified_base (355)..(355): a, c, t, g, unknown or other
  modified_base (364)..(364): a, c, t, g, unknown or other
  modified_base (370)..(370): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacgagccaccctctcctgcagggccggccagactgttgacaacgacttagcctggtaccaacagaagcctggccaggctcccaggctcctcatctatgatacttccagtaggccatggcatcccagccccgnttcagtggccagtgggtcnggggacagngtttcnctcaccatcctcagccctagagcctagaagtatttgctagtttattactgtcagtctccgactaagtaagtcggacctaccaaattacttcctacgttttccggacccttggggaacctaaagtacggattacgtacaaaacgaacttgtacggctgaacacactactgtcttacacttcc

SEQ ID NO: 435348 - DNA, 524 bp, Homo sapiens
  misc_feature: GZ8MTXP02I1FJV.25.53.E09.1.454.CMB.2.raw
  modified_base (328)..(328): a, c, t, g, unknown or other
  modified_base (364)..(364): a, c, t, g, unknown or other
  modified_base (520)..(520): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccggccagactgttgacaacgacttagcctggtaccaacagaagcctggccaggctcccaggctcctcatctatgatacttccagtagggccatggcatccccagcccgnttcagtgcaggtgggtcctggggacagtagtttacnctcaccatcctccagccctaagacgtcctagaagtatttgctagtttattactgtcagctcgacaaagagtcggcctacattatcacttcggcctgggaaccaagtgatatacaaacgtactgagctcgacaccatctgtacttcactccgtcccnctac

SEQ ID NO: 435349 - DNA, 523 bp, Homo sapiens
  misc_feature: GZ8MTXP02JGSG2.25.53.E09.1.454.CMB.2.raw
  modified_base (332)..(332): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccggccagactgtgacaacgacttagcctggtaccaacagaagcctggccaggctcccaggctcctcatctatgatacttcagtaggccatggcatcccagcccgnttcagtgccagtgggtctggggacagagtttctctcaccatctcagccctagagcctagaagattttgactagtttattactgtcagtctccgacaagtaagtcggacctaccaattattctacgtttcggccctgggaccaaagtcggatatacaaagactgtacgctgcacatctagtcttcacttccg

SEQ ID NO: 435350 - DNA, 564 bp, Homo sapiens
  misc_feature: GZ8MTXP02JF66C.25.53.E09.1.454.CMB.2.raw
  modified_base (375)..(375): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacgagccaccctctcctgcagggccgtcagactgttgacaacgacttagcctggtaccaacagaagcctggccaggctcccaggctcctcatctatgatacttccagtagggccactggcatcccagcccgcttcagtggcccagtgggtctggggacagtagtttaccnctcaccatctccagccctagacgtcctagtaagtatttgacttagtttactacttgtcacgtcctccgacgtaagagtcggaccctactaattacttactacgttccggaccgtacgggtaactaaaggtcgtaatacgtacaaacgtactcgtacgctcgaaccgactactctcgtcctactactccg

SEQ ID NO: 435351 - DNA, 566 bp, Homo sapiens
  misc_feature: GZ8MTXP02GWYO0.25.53.E09.1.454.CMB.2.raw
  modified_base (328)..(328): a, c, t, g, unknown or other
  modified_base (362)..(362): a, c, t, g, unknown or other
  modified_base (385)..(385): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtagggccatggcatcccagcccgnttcagtgcaggtggtcctgggacagtagtttacnctccaccatctccagcctagacncctagaagtattttgctagtttattactgtacagcctaccgactaaaggacgtcggaccttaccaaatttacttcctacgtttccggcccgttaggggaacctaaaggtcgaatactaacaaaacgtaacgtgtaggctacgactaacctatctcgttctactacttccttcccgacttac

SEQ ID NO: 435352 - DNA, 569 bp, Homo sapiens
  misc_feature: GZ8MTXP02FROJE.25.53.E09.1.454.CMB.2.raw
  modified_base (379)..(379): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccggccagactgttgacaacgacttagcctggtaccaacagaagcctggccaggctcccaggcctcctcatctatgatacttccagtacggccacgtggcactcccagccccgcttcagtggccaggtgggtctggggacagtagtttacnctacaccatcctacagcctagacgcctagaagtattttgactagtttattactgtacagtctccgacaagaagtcgacctacaactacttctacgtttccggcccgtagggtaacctaaaaggtcggtaatataacgaaaacgtacgtacgtacggactcgaacacctatcttgtacttctactttcccg

SEQ ID NO: 435353 - DNA, 593 bp, Homo sapiens
  misc_feature: GZ8MTXP02G26IJ.25.53.E09.1.454.CMB.2.raw
  modified_base (333)..(333): a, c, t, g, unknown or other
  modified_base (370)..(370): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacagccaccctctcctgcagggccggccagactgttgacaacgacttagcctggtaccaacagaagcctggccaggcctcccaggctcctcatctatgatactccagtagggccagtggcatccccagccccgtnttcgagtggcaggtggtcctggggacagtagtttacnctcacctatctccagccctagacgcctagaacgttattttgacttaagttttattacgtgtacacggtcctaccgacgtaaagacgttcggaccttaccaattacttcctaaccgttccggacccgtagggaacctaaagtggtaatacgtaacgaaaacgtagtggtaggctacgacctaacctattcgtcgttccttactacttcccttacccctactacg

SEQ ID NO: 435354 - DNA, 550 bp, Homo sapiens
  misc_feature: GZ8MTXP02HKUYA.25.53.E09.1.454.CMB.2.raw
  modified_base (331)..(331): a, c, t, g, unknown or other
  modified_base (369)..(369): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacagccatcctctcctgcagggccgccagactgttgacaacgacttagcctggtaccaacagaagcctggccaggctcccaggctcctcatctatgattacttccaggtacgggccactggcatcccagcccgnttcagtggcaggtcggggtctggggacagtagtttacnctcaccatcctcagcctagcgcctgaagtattttgctagtttattactgtcagcctccgacaagaagtcggtcctaccaattactctaacgtttcggacccgttagggaacctaaaggtgaagttactacaaacgtaactgtcggctacgcaccaagtctcgtcttacactccttcccgac

SEQ ID NO: 435355 - DNA, 591 bp, Homo sapiens
  misc_feature: GZ8MTXP02H4FJT.25.53.E09.1.454.CMB.2.raw
  modified_base (335)..(335): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagcccaccctgtctttgtctccgggggaacagccaccctctcctgcagggccgcagactgtgacaacgacttagcctggtaccaacagaagcctggccaggctcccaggctcctcatctatgatacttcagtacggccatggcatcccagccccgnttcaggtggccaggtcgggtctggggacagtagtttactctacacctatcctccagtccctagcgcctgaagtatttgacttagtttattactgtcagtctccgacaagaagtcggacctacctaaattacttacttaccgtttccgggaccccgtagggtaacccgtaaaacggtcggaattaactaacaaaacgtaaaccgtcggttaggctggaacctaccgaacttactacggtttcttctaactttccccg

SEQ ID NO: 435356 - DNA, 571 bp, Homo sapiens
  misc_feature: GZ8MTXP02GW6KR.25.53.E09.1.454.CMB.2.raw
  modified_base (333)..(333): a, c, t, g, unknown or other
  modified_base (369)..(369): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccgccagactgtgacaacgacttagcctggtaccaacagaagcctggccaggctcccaggctctcatctatgatacttccagtaggccatggcatcccagcccgnttcagtgccagtgggtctggggacagtacgtttacnctcaacccattcctaccagtccctagacgcctagaaagtatttgactagtttattactgtcagctccgacaagtaagtggacctacaacttacttctacgtttccggcccttacgggggaacctaaaaggtacggaataacgtacaaaacggtaactagtacggctacgaacctactaactcctagtccttactacttcccg

SEQ ID NO: 435357 - DNA, 515 bp, Homo sapiens
  misc_feature: GZ8MTXP02F7PQX.25.53.E09.1.454.CMB.2.raw
  modified_base (264)..(264): a, c, t, g, unknown or other
  modified_base (330)..(330): a, c, t, g, unknown or other
  modified_base (364)..(364): a, c, t, g, unknown or other
  modified_base (425)..(425): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccgccagactgtgacaacgcttagcctggtaccaanagaagcctggccaggctcccaggctcctcatctatgatctcagtaggccatggcatcccagcccgnttcagtgccagtgggtctggggacagtagtttcnctacacctatcctaccagccctagacgcctagaagtattttgactagttttatactgtacngtctccgacaagagtcgacctacaatatctacttcgcctaggaccaaagtgatatacaaagactgtacgctagcacatctgtactcatcc

SEQ ID NO: 435358 - DNA, 682 bp, Homo sapiens
  misc_feature: GZ8MTXP02IM6W3.25.53.E09.1.454.CMB.2.raw
  modified_base (270)..(270): a, c, t, g, unknown or other
  modified_base (341)..(341): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagcccaccctgttctttgtccgtccgggggaacagccaccctctcctgcagggccgccagactgttgacaacgacttagcctggtaccaanagaagctggccaggctcccaggctcctcatctatgatacttccagtaggcccagtgcactcccagcccgtnttcgagtcgccgtaggtcggtcgtgggactaggttactttcgtctaccaccctattcccgtacacgtccgtaaagcgacccgttaagaaattgtttttagaccgtttaagtttttaacttaccggtttcgtaccgtacgtacccgtaccgtaaagtaaacgggtacggtccgtacctaaaccttagttaccttaccgttacccggtttccggaccggttaacgggaaaaccgttaagggtacgtaaacgttaaacgtaaaccgtaaaacggtacgttcggtaccgtacgtacgtaacctaacctactttccgttacgtttaccttacgtacctttaccccg

SEQ ID NO: 435359 - DNA, 540 bp, Homo sapiens
  misc_feature: GZ8MTXP02F6KRC.25.53.E09.1.454.CMB.2.raw
  modified_base (266)..(266): a, c, t, g, unknown or other
  modified_base (271)..(271): a, c, t, g, unknown or other
  modified_base (301)..(301): a, c, t, g, unknown or other
  modified_base (334)..(334): a, c, t, g, unknown or other
  modified_base (369)..(369): a, c, t, g, unknown or other
  modified_base (433)..(433): a, c, t, g, unknown or other
  modified_base (453)..(453): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagcccaccctctcctgcagggccggcagactgttgacaacgacttagcctggtaccaanagaancctggccaggctcccaggctcctcatctangatcttccagtaggccatgcactccagccccgnttcagtgcctagtggtctggggacagtagtttacnctcaccatctccagccctagagccctgaactattttgctagtttattactgtacagtctccganaagaagtcggacctacaatnttactactttcggccctagggacctaaagtcggtaatacgtacaaacgtaacgtgtacggctgcaccatccttgtcttactacttcc

SEQ ID NO: 435360 - DNA, 579 bp, Homo sapiens
  misc_feature: GZ8MTXP02JYMIX.25.53.E09.1.454.CMB.2.raw
  modified_base (336)..(336): a, c, t, g, unknown or other
  modified_base (370)..(370): a, c, t, g, unknown or other
  modified_base (376)..(376): a, c, t, g, unknown or other
  modified_base (404)..(404): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtaggccatggcatcccagcccgnttcagtgccagtgggtctggggacagagtttccncacacntcctacagcctagacgtctagtaagttntttgacttagtttattacgtgtacagtcctacgacaagtagtcgacctactaattacttacctacgttccggaccgtacgggaaacctaaaggtcgtaactacgtaaacgaaaacgtacgtcggtacgtactacgaaccgtaactacgttcgtacgttcctttactaccttcccg

SEQ ID NO: 435361 - DNA, 620 bp, Homo sapiens
  misc_feature: GZ8MTXP02JCASJ.25.53.E09.1.454.CMB.2.raw
  modified_base (335)..(335): a, c, t, g, unknown or other
  modified_base (373)..(373): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccggggaacagccaccctctcctgcagggccgccagactgtgacaacgcttagcctggtaccacagaagcctggccaggcctccaggcctcctcatctatgatcttccagtacggccactggcactcccagccccnttcagtggccaggtgggtctggggacaggtagtttccnctacacctatcctacacgtccctagcgtcctagtaagtagttttgacttagtttacttactcgtacacgtcctaccgacgtaaagtaacgtcggacccttaaccaattacttacctaccgtttccggaccccgttaggggtaaaacccgaaaaggttcggaaacttaaccgtaacgaaaaaccggtacgttaggtcggtactacgaacctaaccgacttaccgttactccttacctactttaccccg

SEQ ID NO: 435362 - DNA, 664 bp, Homo sapiens
  misc_feature: GZ8MTXP02GOCCR.25.53.E09.1.454.CMB.2.raw
  modified_base (387)..(387): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgctccggggaacagccaccctctcctgcagggccgcagactgtgacaacgacttagcctggtaccaacagaagcctggccaggcctcccaggcctcctcatctatgatacttccagtacggccacgtggccatccccgagccccgtcttcgaggttcggccaggtcggggtctggggactaggtagtttaccnctacacctatcctaccagccctagacgcctagaaacgtattttgacttagttttattacgttgtactacgtccttaccgacgtaaacggtaacgtcgggtacccttacaaacttaacttcccgttaaccgttttccgggacccccgttagggggaaaaccccttaaaagggtacgggtaacttaaacgtaaccgaaaaacggtaaccgttacgggtaacggtccgttacggaaccgtaacccgtaactcgttacgttccctttactacctttccccg

SEQ ID NO: 435363 - DNA, 577 bp, Homo sapiens
  misc_feature: GZ8MTXP02F8JXA.25.53.E09.1.454.CMB.2.raw
  modified_base (333)..(333): a, c, t, g, unknown or other
  modified_base (369)..(369): a, c, t, g, unknown or other
  modified_base (382)..(382): a, c, t, g, unknown or other
  modified_base (403)..(403): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccgcagactgttgacaacgacttagcctggtaaccaacagaagcctggccaggcctcccgaggcctcctcatctatgatactcagtggccatgcatcccagcccntcagtggccaggtgggtctgggacaggtacgtttcnctcacctattccnccagcctagagcctagaagtntttgctagtttatactgtacagtcctacgacaaagtaagtcggtaccctactaaacttacgttacctaaccgttttccggacccgttaggggaaccctaaaaggttggaaactaagtaccaaaacggtaacgtggtacgcgtagaaccgacctagtctagttctactacttccc

SEQ ID NO: 435364 - DNA, 642 bp, Homo sapiens
  misc_feature: GZ8MTXP02JTZOB.25.53.E09.1.454.CMB.2.raw
  modified_base (301)..(301): a, c, t, g, unknown or other
  modified_base (342)..(342): a, c, t, g, unknown or other
  modified_base (381)..(381): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccgccagactgtgacaacgacttagcctggtaccaacagaagcctggcccaggctcccaggctcctcatctangatacttccaggtacgggccacgtggcactcccagccccgnttcagtgccaggtgggtctaggggacaggtagtttaccnctaccactactcctaccgacgtacctagacgtaccgtagtaagttagtttacgacttagtttacttacgtgtactacgtccgtaccgaacgaaaggtacgtacgtaccctactaacttacgttaccgtaccgtttcccggacccgtacgggtaaaccgtaaaggtacggtaactaacgtaaacgtaaaacggtacgtacggtacggtactacgaacctaaccgtacgttccgttacgtttaccttacctaccgtttacccg

SEQ ID NO: 435365 - DNA, 657 bp, Homo sapiens
  misc_feature: GZ8MTXP02IMDVN.25.53.E09.1.454.CMB.2.raw
  modified_base (418)..(418): a, c, t, g, unknown or other
  modified_base (459)..(459): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagcccaccctgttctttgtcgtccgggggaacagccaccctctcctgcagggccgccagactgttgacaacgacttagcctggtaccaacagaagcctggccaggcctcccgaggcctcctcatctatgtataccttccgaggtacgggcccacgtcggcctacgtccccacggcccccgtactttccgaggtcggcctaggggtcggggtctacgggggactaggttacgttttaccnctaccaccctattcctaccgagtccctagacgcctagaatntttgacttagttttatactgtacgagtccgtccgacaaaggtaacgtcggacccttacctaattacttaccgtaccgtttccgggtaccccgtaggggtaaacccgtaaaaggttcgaacgttaaacgtaactaaaaacggtacgttacgcggtactacggtaaccacgtactctacgtttccttactactttccccg

SEQ ID NO: 435366 - DNA, 744 bp, Homo sapiens
  misc_feature: GZ8MTXP02HRFTJ.25.53.E09.1.454.CMB.2.raw
  modified_base (305)..(305): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagcccaccatgtctttgtctccgggggaacagccaccctctcctgcagggccgccagactgtgacaacgacttagcctggtaaccaacagaagcctggccaggcctcccaggcctcctcatctatnattacttcaaggtacggccacgtggctacgtcccagccccgtcttcgagtcggctagggtcgggtcgttggggaccaggtacgttttacctctaccaccctatccctaccacgacccttaaggacgtcccgttaaggaaagtttaagtttttcggacctttaaggtttttaactttaacgttcgttacgtaacggtccttaccggaacgtaaaacgggtaaacggtcgggtaccccttaacccgtaaaagtttaccttaccgttaaaccggttttccccgggacccggttaccgggggtaaaaccccgtaaaaggttaaccgggtaaattaaaccgttaaccgtaaaaaccgttaaacgttcggttaacgggcctttaacgggacccgtaaacccttaacggttacctttaccggtttacctttcccgtttaaaccccg

SEQ ID NO: 435367 - DNA, 634 bp, Homo sapiens
  misc_feature: GZ8MTXP02HI7MN.25.53.E09.1.454.CMB.2.raw
  modified_base (348)..(348): a, c, t, g, unknown or other
  modified_base (442)..(442): a, c, t, g, unknown or other
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacgacgcccaccctctcctgcgacgggccggccagactgttagacaacgacttagcctaggtaaccaacgagaacgcctggccaggcctcccgaggcctcctcatctatgatacttcaggtacgggccacgtggacactcccacgcccgnttcgagtggacgtaggtcgggtccgtaggggactaggtacgttttactcctacaccctatcctaccacgtacctagacgtccgtagtaaagttnttttgacttaagtttacttacgtcgtactacggcctaccgagaaaaggtacgtccggtaccttaacaaattacgttacctaccgtttccggacccgttagggaaaccgtaaaggttcgaaataacgtaacgaaaacgtaccgtgacggtctagaccaaccgtatcgtctcttcacttcccttacccactacg

SEQ ID NO: 435368 - DNA, 714 bp, Homo sapiens
  misc_feature: GZ8MTXP02GW3CW.25.53.E09.1.454.CMB.2.raw
  modified_base (386)..(386): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccggggaacagccaccctctcctgcgagggccgccagactgttgacaacgacttagcctggtaccaacagaacgcctggcccaggcctcccgaggcctcctcatctatgactactccagtacggccacgtggcactcccagcccgcttcgagtggcccaggtcggtctaggggacagttacgtttcncgtcacctatccctaccacgtccctaagcgtaccctagtaaacgttattttacggactttaaggttttaacttacgttcgtaccgtacgtaccgttaccgtaacgaaaacggttaacgtaccgggtaccctaaccgtaaactttacctttacccgttacccggtttacccgggtaccccgttaacggggtaaacccgtaaaacgggttacgggtaacgttaaacttaaacccgaaaacggttaaaaccgtgggttacggtaccgttacggaacccgtaaacccgttaacgttaccttcggtttacctttaccgtaccgtttacccccg

SEQ ID NO: 435369 - DNA, 552 bp, Homo sapiens
  misc_feature: GZ8MTXP02FKT1H.25.53.E09.1.454.CMB.2.raw
  modified_base (267)..(267): a, c, t, g, unknown or other
  modified_base (375)..(375): a, c, t, g, unknown or other
  modified_base (389)..(389): a, c, t, g, unknown or other
  modified_base (394)..(394): a, c, t, g, unknown or other
  modified_base (405)..(405): a, c, t, g, unknown or other
  modified_base (437)..(437): a, c, t, g, unknown or other
  modified_base (538)..(538): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggccggccagactgttgacaacgacttagcctggtaccaanagaagcctggccaggctcccaggctcctcatctatgatacttccagtacggccactggcactcccagccccgcttcagtggcaggtgggtctggggacagtagtttcnctcaccatcctcanctagngcctgaaagtnttttgctagtttattacgtgtacagctccganaagtacgtggacctactaatattcctacgtttccggacccttaggggaacctaaagtcggatataccaaaacggactggtacggctgaacaccatccgttnttcctactactccg

SEQ ID NO: 435370 - DNA, 627 bp, Homo sapiens
  misc_feature: GZ8MTXP02IK5AZ.25.53.E09.1.454.CMB.2.raw
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacgagccaccctctcctgcagggccgccagactgttgacaacgacttagcctggtaccaacagaagcctggccaggctcccaggcctctcatctatgatacttccagtaggccactggcatcccagccccgcttcagtgccaggtgggtctggggacagtagtttacctctcaccatcctccagtccctagacgcctgaaacgtgttttgcttaagttttacttactggtcaagtcctccgacgaaacggtagtacggtccctaactaaatttactttaccgtaacgttttccggaccccgttgggggaaaacccctaaaagggttacggaaatttaacgtaacgtaaaaaccgtaaacgttcggtacggtactcgtaaccaaccgtaacttccgtacgtttccttaccttactttcccccg

SEQ ID NO: 435371 - DNA, 533 bp, Homo sapiens
  misc_feature: GZ8MTXP02HMXAL.25.53.E09.1.454.CMB.2.raw
  modified_base (333)..(333): a, c, t, g, unknown or other
  modified_base (405)..(405): a, c, t, g, unknown or other
tcagactgtacagtcacgaccggtgctcgatttagagagagtgtgttgggtttggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccaccctctcctgcagggccggccagactgttgacaacgacttagcctggtaccaacagaagcctggccaggctcccaggcctctcatctatgatacttcagtaggccatggcatcccagccccnttcagtggccaggtggtctggggacagtagtttcctctacacctatcctaccagccctagacgcctgaagtnttttgctagtttatactgtacagtctcgacaagtagtcgacctacaaatcttacacgttcgcctagggacctaaagtcgatatacgaaacgactgacgctgaactacattctgttccttctacttccc

SEQ ID NO: 435372 - DNA, 645 bp, Homo sapiens
  misc_feature: GZ8MTXP02FTZIV.25.53.E09.1.454.CMB.2.raw
  modified_base (404)..(404): a, c, t, g, unknown or other
  modified_base (471)..(471): a, c, t, g, unknown or other
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagcccaccctgtctttgtcgtccgggggaacagccaccctctcctgcagggccggccagactgttgacaacgacttagcctaggtaccaacgagaacgcctgtcccaggcctcccaggcctcctcatctatgactaccttccgagtacgggccacgtggaccactccccacgcccccgtcttacgacggtggcgtaggttcggggtcccttaggggacaggttacgttttacnccgtaccaccactcctaccagcccttaaggacgtcctagtaagttattttgacttagtttattacgngttcaacgtctaccgactaagtaacgtcgtaccctactaaattcttacgtaccgtttccgaccggtaggtaaaccaagtacggtaataactaaacgaaaaccgtaatggttacggacttacggaccaacccgtatccttcggtccttactacttcccgttacccgacctttaac

SEQ ID NO: 435373 - DNA, 618 bp, Homo sapiens
  misc_feature: GZ8MTXP02IU6W6.25.53.E09.1.454.CMB.2.raw
  modified_base (344)..(344): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtccgtccgggggaacagccacctctcctgcagggccgccagactgttgacaacgacttagcctggtaccaacagaagcctggccaggcctcccaggcctcctcatctatgatacttccagtacggccacgtggcactcccagccccgtnttcagtcggcctaggtgggtctggggacaggttacgtttactctaccacctatcctaccacgtccctagacgtcctagaacgtattttgacttagttttattactgtacagtcctaccgacaaaggacgtcggacctacctaaattacttacgtacgtttacccggcccgttaagggaacccaaaaggttacggaattaaacgtaactaaaaccggtacttggtacggtctacggaacctaccgtacttccttagttcctttacactttccccg

SEQ ID NO: 435374 - DNA, 570 bp, Homo sapiens
  misc_feature: GZ8MTXP02JD3UC.25.53.E09.1.454.CMB.2.raw
  modified_base (296)..(296): a, c, t, g, unknown or other
  modified_base (340)..(340): a, c, t, g, unknown or other
  modified_base (405)..(405): a, c, t, g, unknown or other
  modified_base (416)..(416): a, c, t, g, unknown or other
  modified_base (552)..(552): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccgggggaacacgccaccctctcctgcagggccgccagactgtgacaacgacttagcctggtaccaacagaagcctggccaggctcccaggcctccncatctatgataccttccagtacggccatggcactcccagccccncttcaggtcgccgtagtcgggtctaggggacaggtatttcctctcaccactcctcacgcctaagngcctagaagtntttgacttagtttacttactgtacacgtctccgataagacgtcgacctacaattctacttacgttccggccttagggaaccctaaaggtcgagtactaacgaaaacgactaggtacgcgtacaactacctactctntctttaccactttccccg

SEQ ID NO: 435375 - DNA, 591 bp, Homo sapiens
  misc_feature: GZ8MTXP02ILOCA.25.53.E09.1.454.CMB.2.raw
  modified_base (376)..(376): a, c, t, g, unknown or other
  modified_base (449)..(449): a, c, t, g, unknown or other
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggcctcccaggctcctcatctatgatacttccagtacgggccactggcactccccagccccgtcttcaggtcggcaggtcgggtcctggggactgtagtttacncttcacctatcctccagccctagctccctagtaacgtattttgcttaagtttacttactgtcacgtctccganaagagtcgaccttacaacttatcctacgttccggccgttagggaacctaaaggtgtataacttacgaaaacgtaacgtgtagggtctacggacctaacctattcctacgttccttacctacgtttcccctcccgtaccttac

SEQ ID NO: 435376 - DNA, 579 bp, Homo sapiens
  misc_feature: GZ8MTXP02G5268.25.53.E09.1.454.CMB.2.raw
  modified_base (288)..(288): a, c, t, g, unknown or other
  modified_base (369)..(369): a, c, t, g, unknown or other
  modified_base (376)..(376): a, c, t, g, unknown or other
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtccgggggaacagccaccctctcctgcagggccggccagactgttgaacaacgacttagcctggtaccaacagaagctggccaggctcccaggctccncatctatgatactcagtaggccatggcactcccagccccgtcttcaggtcgcaggttcggctaggggacagtacgtttacnctcactntcctccagcctagcgcctagaagttagttttgacgttagtttagttactcggttacagtcctaccgactaaaggacgtcggaccctactaattacttacctaccgtttccggaccgttacgggaacctaaaggtcgtaataactaacgaaaacgtacgtagtcgcgtcgacacctatcgttactctctactccttccactacg

SEQ ID NO: 435377 - DNA, 717 bp, Homo sapiens
  misc_feature: GZ8MTXP02HSFNH.25.53.E09.1.454.CMB.2.raw
tcagactgtacagtcacgaccggtgctcgatttagagagagtgtgttgggtttgggggaggaactgctcagttaggacccagagggaaccatggaagccccagctcagcttctcttcctcctgctactctggctccagtttcagattccagcggcgaaactgtgttgacacagtctccagccaccctgtctttgtcgtccggggaacgcgccaccctctcctgcgagggccggccagactgttcgacaacgtacttagcctaggaaccaacagaacgccgtggccaggcctcccgaggcctcctcatctatgactaccttcgaggtacggcctagtcggactactccccacgccccgtcttcgaggtggacccgtagggttcggggtcgtacggggaactaggttaacgttttacctctaccaacctacttcctacccgaacgtccctaagacgtaccttaggaacgttagttttcgtactttaagttttaacttacgttcgtacgtaacgtccgttaccgaacgtaaaacggttaacggtccggtacccttaacccgttaaattacctttaccgttaaccggttttcccgggacccggttaacgggtaaaacccgtaaaaggttcggtaaaacttaacgtaaaccgtaaaaacggtacgttaggtacgtacgtacgaaccgtaactaacgttctacgtttccttactactttcccg

SEQ ID NO: 435378 - DNA, 621 bp, Homo sapiens
  misc_feature: GZ8MTXP02HSX6A.25.53.E09.1.454.CMB.2.raw
  modified_base (271)..(271): a, c, t, g, unknown or other
  modified_base (342)..(342): a, c, t, g, unknown or other
  modified_base (375)..(375): a, c, t, g, unknown or other
  modified_base (400)..(400): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccacctgtctttgtcgtccggggaacagccaccctctcctgcgagggccggccagactagttaaacaacgtacttagcctaggtaccaanagaacgcctggccaggcctccaggctcctcatctatgatacttccagtacggccatggcactcccagcccntcagtggcaggtggtctgggacagtagtttacnctacaccatcctacacgcctagacncctagaagtatttgacttagtttactactgtactacgctccgactaaaggaacgttcggaccctacctaaattactttaccgtaccgtttacccgggacccgttaacggggaaacccgtaaaaacggtggtaaactaacgtaaaccgaaaaaccgtaaacgtggttacggacttacgaccaaccgtactcttcgttaccttccgaactttcccgtaccccg

SEQ ID NO: 435379 - DNA, 536 bp, Homo sapiens
  misc_feature: GZ8MTXP02JELK8.25.53.E09.1.454.CMB.2.raw
  modified_base (300)..(300): a, c, t, g, unknown or other
  modified_base (336)..(336): a, c, t, g, unknown or other
  modified_base (377)..(377): a, c, t, g, unknown or other
  modified_base (418)..(418): a, c, t, g, unknown or other
  modified_base (527)..(527): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccggggaacagccacctctcctgcagggccgccagactgtgacaacgacttagcctggtaccaacagaacgcctggccaggcctccgaggctcctcatctangatcttccagtacggccactggcatcccagcccctnttcagtggccaggtcgggtctggggactaggtacgtttacncgtaccacctactcctacagtccctagacgcctagaaagtntttgcttagtttatactgtcagcctcgacaagtagtcgcctacaattctctacgtttacgccgtaggacaacgtgatactacgaaacgactgacgcctgcacgtctctntctacactc

SEQ ID NO: 435380 - DNA, 611 bp, Homo sapiens
  misc_feature: GZ8MTXP02INA7J.25.53.E09.1.454.CMB.2.raw
  modified_base (448)..(448): a, c, t, g, unknown or other
tcagactgtacagtcacgaccggtgctcgatttagagagagtgtgttgggtttggggaggcgtggtccagcctgggaggtccctgagactctcctgtgaagcctctggattttagtttcagtggttctggcatgcactgggtccgccaggctccaggcaaggggccggagtggttggcagttatagcacatgatggaagttctgaatattatgcagactccgtgaaggccattcacatctccagagacaacttcccgaacattgtgtacttggaaactggtcagcctgagagtcgaggactcggctctgtatttacgtgtgcgagatcggggaggtggtagtagttagtaccggggcacatggactgggggccagggggaccctggtccaccgtctccctacacgccctaccaccgaacgggccctacgtcccggtcccttcccccgngggcccgccccttgccctccgagggaccgtccacccgtaccgagaccgcaaccgtacggcccggcccgtggggcctcggccccgtgggttaccaaagggtaccctacgttaccctacgttacggtaacgtacgtacgtcggacggtccgggcgtcggaaccgg

SEQ ID NO: 435381 - DNA, 569 bp, Homo sapiens
  misc_feature: GZ8MTXP02F251I.25.53.E09.1.454.CMB.2.raw
  modified_base (337)..(337): a, c, t, g, unknown or other
  modified_base (370)..(370): a, c, t, g, unknown or other
  modified_base (555)..(555): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccacccctctcctgcagggccggccagactgttgacaacgacttagcctggtaccaacagaagcctggccaggctcccaggcctcctcatctatgatctcagtaggccacgtgcactcccagcccgnttcagtgccagtgggtctgggacagtagtttcnctcaccatcctccagtcctagacgcctagaagtatttgactagtttattactgtacagtctccgacgaagagtcggtaccctaccctaattacttacctaacgtttccggaccccgttagggaaccctaaaggtacggtattaactacgaaaacgtaactgttacgctagaacacctatccgttnttccttactactcc

SEQ ID NO: 435382 - DNA, 695 bp, Homo sapiens
  misc_feature: GZ8MTXP02JJVLC.25.53.E09.1.454.CMB.2.raw
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccgggggaacacgccaccctctcctgcagggccggccagactgttgacaacgacttagcctggtaaccaacagaacgcctggccaggcctacccaggcctcctcactctatgataccttccaggtacgggccagtcggacactcccagccccgtcttcaggtcggacctagggtcgggtcgtaggggactagtacgtttactctcgaacctactcctacacggtcccttaagacgtaccctagtaaagtacgtttttacgcgttaaggttttactttaacgttggtactacgtccgttaccgacgaaaagtaacgtcggacccttacaaacttaacgttcctacgttttccggacccgttagggggtaaaccctaaaaggtttaccgggaatttaacgtaaaccggtaaaaccggtaaactttcggggacgggtccttaacgggcccgtaaaacccgtacgttacccttcggttacctttccgaacttttcccccg

SEQ ID NO: 435383 - DNA, 673 bp, Homo sapiens
  misc_feature: GZ8MTXP02IW9ZU.25.53.E09.1.454.CMB.2.raw
  modified_base (400)..(400): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagattccagcggcgaaactgtgttgacacagtctccagccaccctgtctttgtcgtccgggggaacagcccaccctctcctgcagggccggccagactgtgacaacgacttagcctggtaccaacagaacgcctggccaggcctcccgaggcctcctcatctatgactacttccaggtacggccacgtcggcactccccgacgtcccgcttcgaggtggacctagggttccggggtcgtaggggactaggtacgttttaaccncctccaacctactcctacccgagcccgttaagacgaccttagtaaacgttagttttcgaacttaagttttacttacgtgttccgaacggtccttacggaacaaacggtacggtccgtaccttacctaatttacgttcccttaacggtttcccggacccggttaacgggaacctaaagggttacgtaactaacgtaaccgtaaaacgtaaccgttgtacggtcctaacgtccaacctaagtttctcgttacctactacccttccggttcccaac

SEQ ID NO: 435384 - DNA, 704 bp, Homo sapiens
  misc_feature: GZ8MTXP02F2TXI.25.53.E09.1.454.CMB.2.raw
  modified_base (338)..(338): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtcgtccggggaacagcccacctctcctgcacgggccggcagactgttgacaacgtacttagcctaggtaaccaacagaacgcctggccaggcctccgaggtcctcctcatctatgtatacttcagtacggccacgtggctacncccacgcccgtctcgaggtcggaccgtagggttcgggtcggtacggggaactacggttacgtttacctcctacctaacctactcccgtaccgacgtaccgtaagaccgtaccgtaggtaaacgtttagttttacgacgtttaaggtttttaacttacgtacgtaccgtacgtacccgtacccgaaagtaaacgggtacgtaccggtaccctaactaaacgttacttaccgttaccgtttcccggaccggtaacggtaaaccgtaaaggtacggtaacttaacgtaaaccgaaaaccgtacggttacggtcgtaccgtacgaaccctaccgtaactccgttacgttccttacctaccgtttcccccg

SEQ ID NO: 435385 - DNA, 742 bp, Homo sapiens
  misc_feature: GZ8MTXP02FZZWJ.25.53.E09.1.454.CMB.2.raw
  modified_base (276)..(276): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggacgaaactgtgttgacacagtctccagccaccctgttctttgtccgtccgggggaacacgcccacctctcctgccgagggcccggcagtactgtgaacaacgacttagcctggtaaccaanagaacgccgtggccacggcctacccgaggcctcctcatactatgtactacctttccgaggtacggcctacgtcggacctaccgtccccgacgtccccgtcttcgacggttcggcccgtagggtcggggtacgtacggggactaaggttacttttccgcctacaacctacttcctaccgaacgtccgtacgacgtaccctaaggttaaacgtttcgttttacgactttaacggtttttaacttacgttcgttacgacgttacccgttaccgaacgtaaaacgggtacgtaccggtacccttaacctaaacgtttacgtaccctttaccggttttacccgggacccgttaacgggtaaaacgtaaacggttacggaaaacttaacggtaaacgtaaaaccgtaacgtcgtacggcttaccgaaccgtacctaacggtttcttaccgttccttaactaccgtttccccg

SEQ ID NO: 435386 - DNA, 602 bp, Homo sapiens
  misc_feature: GZ8MTXP02FQTTC.25.53.E09.1.454.CMB.2.raw
  modified_base (266)..(266): a, c, t, g, unknown or other
  modified_base (343)..(343): a, c, t, g, unknown or other
  modified_base (372)..(372): a, c, t, g, unknown or other
  modified_base (378)..(378): a, c, t, g, unknown or other
  modified_base (385)..(385): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccaccctgtctttgtctccgggggaacagccaccctctcctgcagggcctgccagactgttgacaacgattagcctggtaccaanagaagcctggccaggctccgagcctctcatctatgactactccgagtacggcctacgtggctactccccagccccgnttcagtcggcagtgggtctgggacaggtntttacnctcaccntctcccgagcctagacgtcctagaaagttatttagcgttaagttttaatttaaccttggtctaagccttaccgacgaaggtaagtcgggacctaccaattacttacctacgtttccggtacccgtacggggtaaaccctaaaggtacgggtaattacgtaaactaaaacggaacgtaggtcggactaagaccacctacgtcttcgtctacttaaccg

SEQ ID NO: 435387 - DNA, 719 bp, Homo sapiens
  misc_feature: GZ8MTXP02JT0WZ.25.53.E09.1.454.CMB.2.raw
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctcagccaccctgtctttgtcgtccggggacacgccaccctctcctgcgacgggccgcagactgtgacaacgactagcctaggtaccaacagaacgccgtggccaggcctccgaggcctacctcatcttatcgtaacttacctttccaggtacgggccctaacgtcggacctacctaccccacggccccgtacgttaccgagggtcggacccgtaggtcggggttccgagggggaactaggtacgttttacctctaccaccgtactacccgttcgacgtacccgttagaacgtccgttaagtaaacggtttatttttacgacgtttaaggtttaactttacgttccgggttactacgtaccgtaccgtaaccggaaggtaacgtcgggtaccctaacaaacgtttacttaccgttaaccgttccggaccccggttagggtaacccaaaagggttcggtaaacttagtaaccgaaaacgtacggtcggtacgacgtcgaacccaaccgtaactttcccgtaggttaccttcgtaacctttccccg

SEQ ID NO: 435388 - DNA, 685 bp, Homo sapiens
  misc_feature: GZ8MTXP02JKET3.25.53.E09.1.454.CMB.2.raw
  modified_base (338)..(338): a, c, t, g, unknown or other
  modified_base (366)..(366): a, c, t, g, unknown or other
  modified_base (385)..(385): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagattccagcggcgaaactgtgttgacacagtctccagccaccctgtcttgtcgtccggggaacagccaccctctcctgcgagggccgccagactgttgacaacgacttagcctggtaccaacgagaacgcctggccaggctcccgaggctcctcatctatgacttactccaggtacggccagtggcactcccagccccgnttccgaggtggcgtggtacggggttcgnggggacagggtactttacnctcaccaatcctacacgcctaagacgcctagtaaatgttttcgacttaagtttatccgttagtccgaagccgttaccgactaagtaacggtccggtaccttacgtaaacgtttacctcgttaacccgtttcccgggacccgtaaggggtaaacccctaaagggtacggtaactttaaaccgaaccgaaaacggtaaaccgtagggttacgggtcctaaacggtccccaaacctttaaccttaaccggtttacgtttaacccgttaaaccgttcccccgttttaccgttaccccccgtccg

SEQ ID NO: 435389 - DNA, 783 bp, Homo sapiens
  misc_feature: GZ8MTXP02IV9RL.25.53.E09.1.454.CMB.2.raw
  modified_base (345)..(345): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagccacctgtctttgtctccgggggaacgagccaccctctcctgcagggccgccagactgtgacaacgacttagcctggtaccaacagaagcctggccaggctccaggctcctcatctatgactctttaccagtacggccacgtcggcactcccgacgcccccgtntttcgacggttggcccgtagggttcggggtctaggggactaacggttacgtttacctccgtccaaccgtacttcctaccgacgtcccttaagacggtccctaggtaaacgttagtttttagaccctttaggttttaactttacgttacggtactaacggtcccgttaccgacgtaaacggtaacggttacccgggtaaccctttacccgtaaaactttaccgttacccgtttaacccggtttttacccgggtacccccggtttaaacggggtaaaaccccgttaaaacggggttacgggtaaaacgttaaaccgttaaacccggtaaaaaaccgttaacccggtttacgggttaaccgggtaccttaaccgggtaaccgaacccgtttacgttacccgttacggtttacccgtttaccttaaaccggttttacccccg

SEQ ID NO: 435390 - DNA, 730 bp, Homo sapiens
  misc_feature: GZ8MTXP02I2BGH.25.53.E09.1.454.CMB.2.raw
  modified_base (314)..(314): a, c, t, g, unknown or other
  modified_base (687)..(687): a, c, t, g, unknown or other
tcagactgtacagtcacgaccggtgctcgatttagagagagtgtgttgggtttgggggaggaactgctcagttaggacccagagggaaccatggaagccccagctcagcttctcttcctcctgctactctggctcccagtttcagattccagcggcgaaactgtgttgacacagtctccagcccaccctgttctttgtccgtccgggggaacgacgccaccctctcctgccgacgggccgccagactgttcgaacaacgacttagcctaggtaccaacagaacgctggccaggcctccaggcctccacatctangtactacttcgagtacggccctagtggacctactcccacgtccccgtctttaccgaggttcggacccgtaggggtcggggttaccgtagggggtaacctaacgggtttacggttttaccttcctaccctaaaccggtaccttccccctaccgtaaccggtaccccgttaaaggaccgtacccgttaaagggtaaacgtttacgtttttacgaacctttaagggtttttaactttacgttcgggtactacggtccctacccgtagtaaacggtaacgttccggtacccttacctaaactttcttaccgtaccgtttccggccgttaggaaccgtaaagtcggtataaaccgtacgaaaacgtagtcgtacggtntaccggtaactacgtacttacgtcgtttacctactcttacccg

SEQ ID NO: 435391 - DNA, 719 bp, Homo sapiens
  misc_feature: GZ8MTXP02H8A9Y.25.53.E09.1.454.CMB.2.raw
  modified_base (253)..(253): a, c, t, g, unknown or other
  modified_base (257)..(257): a, c, t, g, unknown or other
  modified_base (260)..(260): a, c, t, g, unknown or other
  modified_base (267)..(267): a, c, t, g, unknown or other
  modified_base (276)..(276): a, c, t, g, unknown or other
  modified_base (283)..(283): a, c, t, g, unknown or other
tcagactgtacagtcacgaccggtgctcgatttagagagagtgtggttgggtttgggggaggaactgctcagttaggacccagagggaaccatggaagccccagctcagcttctcttcctcctgctactctggctcccagtttcagattccagcggcgaaactgtgttgacacagtctccagccacctgtcttgctcggggaacagccacctctcctgcagggccgcagactgtgacagactagctgtacaanaganccngcaggcnccagctccngatctangataaccttccaggtaacgggcccacgtggactaacgtcccaacggtccccactttacgaaggttccggggacttaggggttcgggtaccgtagggggaacctaagggttaagtttttacccctacgtaccaaacccttacgtaccctaccgaaacgtaccgtaacgacgtacgttaacgtaaacgttacgtttacgaacgttaacgtttaactttacgtacgttacctacggtccttacggtaaactaaacggtaacgttaccggtaacccttaacttaaacgtttactttaccgttacccggtttaccggacccggttaacgggtaaaaccgtaaaggtaacggtaaacttaacgaaacgtaaaacgtaaacgtacgtacgtacgtacgtaaccgtaactaacgttacgttacgttaccttacttacctacccg

SEQ ID NO: 435392 - DNA, 505 bp, Homo sapiens
  misc_feature: GZ8MTXP01EGX4D.3.88.H11.1.454.CMB.2.raw
  modified_base (476)..(476): a, c, t, g, unknown or other
tcagagacgcactccacgaccggtgctcgatttagcgacagcgagaacacacaaaggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggttagcctggtatcagcagaaaccagggaaagcccctaaagctcctgatctatgctgcatccactttgcaaactcggggtcccatccaggttcaagcggcaggggatctgggacagatttcactctcaccatcagcagcctgcagcctgaagattttgctaaacttactattgtcaacaggctaaactatttcccctttaaatctttcggccaaagggacacgaacttgganatttaaacgactgtaggcttgcttcctaa

SEQ ID NO: 435393 - DNA, 548 bp, Homo sapiens
  misc_feature: GZ8MTXP01D9GRK.3.88.H11.1.454.CMB.2.raw
  modified_base (276)..(276): a, c, t, g, unknown or other
  modified_base (349)..(349): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggtagctggtatcagcagaaaccaggggaaancccctaaagctcctgatctatgctgcatccactttgcaaactcggggtccatccagttcaagcggcgaggggntctggggacagtatttcactctcaccatccagcagccctgcagcctagaagtattttgactaacttactattgtcaacaggtctaaactactttccctttaaatccgtttcggcctaaaggggacctaacggtacgttagggacgttaagtttaaaaccgggaaacttggtgggtcttacggaaccttaacccgttaac

SEQ ID NO: 435394 - DNA, 525 bp, Homo sapiens
  misc_feature: GZ8MTXP01EZDR7.3.88.H11.1.454.CMB.2.raw
  modified_base (278)..(278): a, c, t, g, unknown or other
  modified_base (409)..(409): a, c, t, g, unknown or other
  modified_base (454)..(454): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagcagaaaccagggaaancccctaaagctcctgatctatgctgcatccactttgcaaactcggggtcccatccaggttcaaagcggcgaggggatcgtggggacagtattcactctacacatcagcagcctggacagcctagaaagttntttcgactaacttactactgtacaacagtattccacctacccctntctcgtttcggggcgggggaaccagggtcggagacttacgaaacgactggtcggcttcgaacaacccgtaa

SEQ ID NO: 435395 - DNA, 548 bp, Homo sapiens
  misc_feature: GZ8MTXP01A9SQ0.3.88.H11.1.454.CMB.2.raw
  modified_base (274)..(274): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggtagctggtatcatcagaaaccagggaaancccctaagctcctgatctatgctgcatccactttgcaaacgtcggggtcccatcccgaggttcaagcggcgaggggatcgtgggacagtatttcactctcacatcagcagcctgcagcctagaagtattttgactaacttactattcgtacaacgtaggtctaaacttacgttttaccctttaaatccgtttacggaccgaaaggggacctaacggtacgttaggacgttaacgtttaaacgaacgttggttcggacttcgaacttaaccgtaa

SEQ ID NO: 435396 - DNA, 537 bp, Homo sapiens
  misc_feature: GZ8MTXP01D84YT.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggttagcctggtatcagcagaaaccagggaaacgcccctaaagctcctgatctatgctgcatccatttgcaaactcgggtccatccaggttcaagcggcgaggggatcgtgggacaggatttcactctcacatcagcagcctgcagcctagagtatttagctaaaaaacttctattgtacaataggacttaaacgtacttttacccttaaatcttacggaccgtaaagggttaccacggtacttaggagaacgtttaaaacgacgtggttacggcttacggcaacccgttaag

SEQ ID NO: 435397 - DNA, 615 bp, Homo sapiens
  misc_feature: GZ8MTXP01DZ4V7.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagcagaaaccagggaaacgcccctaaagctcctgatctatgctgcatccactttgcaaactcggggtccagtccaggttcaaggcggcgaggggatcgtgggacagtatttcactctcacatcagcacgcctgcacgcctagtaagtattttcgactaaactttactattgtacaaacgtacggtaccttaaacttaccggttttacccttttaaacgttcccgtttaccgggttacccggtaaacgggggttaaacctaaccgggtaaccgttagggaaacgttaaacgtttaaaaaccggtaaaccgttgggttacgggtaccgttacgggtaacccgttaacccgttaaccg

SEQ ID NO: 435398 - DNA, 640 bp, Homo sapiens
  misc_feature: GZ8MTXP01EG9FV.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcgaggggtattagcagctggttagcctggtatcagacaaggaaaccgagggaaacgcccctaagcctcctgatctatgctgcactcctactttgacgtaaacgtccggggtcccagtccgtaggttcgaacggcgggcggaggggactcggtgggactaggtactttccacttctaccacactcagacacggtcctgcacgccttagtaacgttagttttacgaaccttaaactttaacttattacgtacctaaacgtaacggttaccttaaaccgtttacgttttaccctttaaacgtccgtttaccggaccgtaaacgggggttacctaacgggtaacgttagggttaaacgttaaacgtttaaaccggtaacgttgggtacgggtcttacggaacccttaaccgttaacg

SEQ ID NO: 435399 - DNA, 559 bp, Homo sapiens
  misc_feature: GZ8MTXP01BCZN8.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcagggtattagcagctggttagcctggtatcagcagaaaccagggaaacgcccctaaagctcctgatctatgctgcatccactttgcaaacgtcggggtcccatccaggttcaagcggcgaggggatcgtggggacagtatttcactctcacatcagcagcctgcagcctagaacgtattttgactaacttactattgtacaacaggtccttaaactagttttacccctttaatccgtttacggaccaaacggggttacaaccggtacgttacgggaagttaacgtttaaaacggaccttaaggttcgggcttacggccttaaccgttaacg

SEQ ID NO: 435400 - DNA, 559 bp, Homo sapiens
  misc_feature: GZ8MTXP01DTSUB.3.88.H11.1.454.CMB.2.raw
  modified_base (250)..(250): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttctagatgcgacatccagatgacccagtctccatcttccgtgtctgcatctgtaggagacagagtcaccatcacttgtcgggcgagtcaggggtattagcagctggtancctggtatcagacagaaaccgagggaaacgcccctaaagctcctgatctatgctgcatcctactttgactaaacgtccgggggtacccatcccgaggttccaaaggcgggcggaggggtactcggtaggggacaggtactttcactctcacatcagcagcctgcagctagaacgtatttcgactaacttactattcgtactaaacgtaggttaactacgttttacccttaatcgttaacggaccgaaagggtacacggtacgtggaacgttaagttaaacgaactgtcggctgacctaacttaacgttc

SEQ ID NO: 435401 - DNA, 588 bp, Homo sapiens
  misc_feature: GZ8MTXP01A70D7.3.88.H11.1.454.CMB.2.raw
  modified_base (276)..(276): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacttgtcgggcgagtcagggtattagcagctggtagctggtatcagcaagaaaccagggaaacncccctaaagctcctgatctatgctgcatcctactttgacaaacgtcgggtcccatccgaggttcaagcggcgaggggatcgaggggacagtactttcacctctacacatcagcagcctgacagcctagaacgttatttacgactaaacctttacgttaattcgttacaacgtacggtaccttaaacgttacgttttacccttaagttccgtttacgggacctaaacggggttaccaaacggtacgttacgggttaagttaaacttaaaaccggtacgttaacggtcggcgttacggaaccttaaccgttaac

SEQ ID NO: 435402 - DNA, 607 bp, Homo sapiens
  misc_feature: GZ8MTXP01A6AK3.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagcaagaaaccagggaaacgccctaaagctcctgatctatgctgctactcctactttcgacaaacgtccgggggtaccccagtcccgtaggttcgaaagggtccgggcgagggggtacttcggtaggggaacctaggtactttaccaccttctaccacctatccaagacacggtcctacggcacgcccgtagtaacggttattttacgtactaaacctttactattcgttacaaacgtaggtacttaacgttacgttttacccttaacttccgttacgggacctaaaggggccaacgtacgttaggacgttaacttaaacgtacgtgtggtccttagccaacgtaac

SEQ ID NO: 435403 - DNA, 564 bp, Homo sapiens
  misc_feature: GZ8MTXP01CZFF3.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagacaagaaaccagggaaacgcccctaaagctcctgatctatgctgcatccactttgacaaacgtcggggtcccagtccgaggttcaaggcggcgaggggatcgtaggggacaggtactttcactctacaccatcagcacgcctgcagctagaacgtatttacgacttaacttactattcgtacaacgtagtaccttaacgttacgtttaccctttaatccgttacggaccgaaggggactaacggtacgttaggagttaacgttaaaacgacgttggtcggacttacggaaccttaacgttaac

SEQ ID NO: 435404 - DNA, 598 bp, Homo sapiens
  misc_feature: GZ8MTXP01BYFY4.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggtagcctggtatcagacaagaaaccgaagggaaacgcccctaaagctcctgatctatgctgcatcctactttgactaaacgtccggggtcccagtccgaggttcaaggcggcgaggggtatcgtagggacagtacttcactctacacatccagcacgcctgacacgtcctagtaagttacgttttagacttaacttacttattacgtaccaaagtaacggtacttaaaccgttacgttttaccctttaatccgtttacggaccgtaaacgggaccgtaacggtacgttagggaacgttaaacgttaaacgaccgttaaggtacgggtcttacggtaaccttaaccgttaacg

SEQ ID NO: 435405 - DNA, 581 bp, Homo sapiens
  misc_feature: GZ8MTXP01AK23M.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagacaagaaaccgagggaaacgcccctaagctcctgatctatgctgcatcctactttgacaaacgtccggggtacccagtccgaggttcaaggcgggcgaggggactcgtacggggacagtactttcactctacacatcagcagctgcagtcctagtagttatttacgacttaacttactattcgtacaaacgtacggtacttaacgttacgttttacccttaagttccgttacgggaccgtaaacgggacctaacggtacgttaggaacgttaacgttaaacggacgttggtacggtcttacggtccttaaccgttaacg

SEQ ID NO: 435406 - DNA, 569 bp, Homo sapiens
  misc_feature: GZ8MTXP01DMI2B.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtcctccattcttccgtgtctgcatctgtaggagacagagtcaccatcacttgtcgggcgagtcaggggtattagcagctggttagcctggtatcagacaagaaaccaagggaaacgcccctaaagctcctagactctatgctgcatccactttgactaaacgtcggggtcccagtccaggttcaaggcggcgaggggatcgtagggacagtacttcactctacacatcagcacgcctgcagcctagaacgttattttcgacttaaacttacttattgtacaacgaaggtacttaacttacgtttccctttaatccgtttaccggacgtaaacggggactaaccggagttaggaacgttaaacgttaaacgaacgttggtaggcttcggaaccaacgttaac

SEQ ID NO: 435407 - DNA, 610 bp, Homo sapiens
  misc_feature: GZ8MTXP01DVKZ5.3.88.H11.1.454.CMB.2.raw
  modified_base (291)..(291): a, c, t, g, unknown or other
  modified_base (610)..(610): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccattcttccgtgtctgcatctggtaggagacagagtccaccatcacgttggtcgggcgagtcgaaggggtattagcagtcgtggtagccgtggtatcagacaagaaaccgagggaaacncccctaaagctctgatctatgctgcatcctactttgactaacgtcgggtccctatccgtaggtcaacggcgggcgaggggtactcggtagggaactagtactttccacttctaccaccgatcgagacacgcctgccagcctaagacgttattttacgacttaaactttactattcgtacaaacgtaacgtaccttaaacgttacgttttaccctttaaagtcccgtttacgggaaccgtaaggggacctaacggtcgttaagggttaagttaaacttaaaccgggaattgggttacggcttacgaacccttaaccgttn

SEQ ID NO: 435408 - DNA, 548 bp, Homo sapiens
  misc_feature: GZ8MTXP01ARYNI.3.88.H11.1.454.CMB.2.raw
  modified_base (276)..(276): a, c, t, g, unknown or other
tcagagacgcactccacgaccggtgctcgatttagcgacagcgagaacacacaaaggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccaggaaacncccctaagctctgatctatgctgctatccactttgcaaacgtcgggtcccatccgaggttcaaggcggcgaggggatcgtgggactagtatttcactctcacatcagcagcctgcagcctagaactagtttgactaacttactattgtacaacgtaggtacctaacttacgttttccctttaaatccgtttcgggacctaaaggggacctaacggacgttgggaagttaacgttaaaacgacgttgggtacgtcgttacgtcaacccgttaa

SEQ ID NO: 435409 - DNA, 577 bp, Homo sapiens
  misc_feature: GZ8MTXP01A8QUE.3.88.H11.1.454.CMB.2.raw
  modified_base (276)..(276): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcattgcgggcagtcagggtattagcagctggtagcctggtatcagcaagaaaccgagggaaacncccctaagctcctgatctatgctgctatcctactttgactaaacgtccggggtacccagtccgtaggttcgaaggcgggcgaggggtatcgtgggacagtatttcactctcaccatcagcacgctgcacgctagtaagtagtttacgacttaacttactattacgtacaacgtacggtacttaacgttacgtttaccctttaattccgttacggaccgtaaacgggaccgtaacggacgttacgggaagttaaacgttaaaacgtacgtggtacggtcgttacgtaaccgttaacctaacg

SEQ ID NO: 435410 - DNA, 597 bp, Homo sapiens
  misc_feature: GZ8MTXP01DNPUU.3.88.H11.1.454.CMB.2.raw
  modified_base (283)..(283): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcgaggggtattagcagctggtagctggtatcagacaagaaaccgagggaaacncccctaaagctcctgatctatgctgcactcctatttcgactaaaccgtcggggtcccagtccgaggttcaaggcggcggaggggtatcgtagggactagtacttacactctacactatcagctacgcctgaccagcctagtaattagttttcgacttaactttactagttacgtacaaacgtacggtacttaaccgttacgttttacccttaattccgttaccggaaccgtaaacgggaccgtaacggtaacgttaggttaagttaaacgttaaacggtaacgtggttcggacttacgaaccgttaacgtaacg

SEQ ID NO: 435411 - DNA, 579 bp, Homo sapiens
  misc_feature: GZ8MTXP01BYJNR.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggtagcctggtatcagcagaaaccagggaaagcccctaagctcctgatctatgctgcatcctactttgctaaacgtcggggtcccatccaggttcaagcgggcgaggggatcgtggggacagatttcactctcacatcagcagcctgcagcctagaacgtagttttcgactaaactttactattgtaccaacgtacggacttaaacctacgtttttaccctttaaattcgttaccgggacctaaacgggggttaccaaacggtaccgttaggggaacgttaacgttaaaaccggaacttcggtacggtcttacggtaaccttaacccgttaacg

SEQ ID NO: 435412 - DNA, 535 bp, Homo sapiens
  misc_feature: GZ8MTXP01EPG47.3.88.H11.1.454.CMB.2.raw
  modified_base (278)..(278): a, c, t, g, unknown or other
  modified_base (414)..(414): a, c, t, g, unknown or other
tcagagacgcactccacgaccggtgctcgatttagcgacagcgagaacacacaaagggggagtcagcccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggtagcctggtatcagcaagaaaccgagggaaacncccctaaagctcctgatctatgctgcactcctactttgactaaacgtccggggtcccatccgaggttcaaaggtcggcgaggggatcgtgggacagtatttcacttctcacatcagcagcctgcagctagaacgtntttcgactaacttactattcgacaagtaggtacttaactacgtttccttaagtcgttacgacgagggttacacgtacgttaggattaacgttaaacgactggtgcttacgcttaaccgtaa

SEQ ID NO: 435413 - DNA, 665 bp, Homo sapiens
  misc_feature: GZ8MTXP01EVL7F.3.88.H11.1.454.CMB.2.raw
  modified_base (202)..(202): a, c, t, g, unknown or other
tcagagacgcactccacgaccggtgctcgatttagcgacagcgagaacacacgaaagggggagtcagacccagtcaggacacagcatgggacatgagggtccccgctcagctcctggggctcctgctgctctggttcccaggttccagatgcgacatccagatgacccagtctccatcttccgtgtctgcatcgtgtagganacagagtccaccatcacttgtcgggcagtcaggggtattagcaggcgtggttagccgtggtatcagacaaggaaaccgagggaaacgcccctaaagcctccgtaggactctaactcgactggacacttcctaacgtttaggacgtaaaccggtccgggggtacccctatacccgtaggttcaaaggtccgggcgaagggggatacgtaggggaactaggtatttccacttctacctaactactcgacgacgaacgtcctaggaccacgtacccgtaaggtaaacgtaactttttacggaaccttaaacgtttaacgttaactttacggtacctaaacgtacgggtaaccttaaacgttaccgttttaccctttaagttccgtttacggaccgtaaacgggacgacggtacgttaggaattaacgttaaacgacgtggtacgcgttacgaaccgttaactaacg

SEQ ID NO: 435414 - DNA, 601 bp, Homo sapiens
  misc_feature: GZ8MTXP01EHVCU.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagatcaccatcacttgtcgggcagtcaggggtattagcagctggtagcctggtatcagcagaaaccagggaaacgcccctaaagctcctgatctatgctgcatcctactttgacaaacgtcggggtcccatccaggttcaagcggcgaggggatcgtagggacagtatttcactctcacatcagcagcctgccagcctagtaacgtagttttagaccttaaactttactactttcgtactaacgtaggtacttaaaccttacgtttttaccctttaacgttccgtttacgggttaccgaaacgggggttaaccaaccgggtaaccgttagggaaacgttaaacgtttaaaaccggtaacgttaaggttacggacgttacggaaccgttaaccgttaaccg

SEQ ID NO: 435415 - DNA, 571 bp, Homo sapiens
  misc_feature: GZ8MTXP01BB5P7.3.88.H11.1.454.CMB.2.raw
  modified_base (284)..(284): a, c, t, g, unknown or other
  modified_base (427)..(427): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcgaggggttattagcagtcgtggtagcctggtatcagcaaggaaaccagggaaacncccctaagctcctgatctatgctgctactccactttgactaaacgtcggggtaccctagtccgaggttcaacggcgggcgaggggactgtagggactagtactttcactctcacatcagacacgctcgcacgcctagaagttntttacgacttaacttactattcgtactaacgacgtacttaaccgttacttttacccttaagttccgttacggaccgtaaacggccgtaaacggacttagggttacttaacgtaaacgacgtggtggcttagccttaaccgtaag

SEQ ID NO: 435416 - DNA, 579 bp, Homo sapiens
  misc_feature: GZ8MTXP01BGBHT.3.88.H11.1.454.CMB.2.raw
  modified_base (275)..(275): a, c, t, g, unknown or other
  modified_base (398)..(398): a, c, t, g, unknown or other
  modified_base (414)..(414): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatccttccgtgtctgcatctgtaggagacagagtcaccatcacttgcgggcgagtcagggtatagcagctggtagctggtatcagcagaaaccagggaaacncccctaaagctcctgatctatgctgcatcctatttgactaaacgtcggggtacccatccgaggttcgaagcgggcgagggggatcgtggggactagtactttcactctcacatcagcagtccngcagcctagtaacgtntttcgactaacttacttattcgtacaactaggtacttaaccttacgttttccttaaacgttccgtttaccggaccgtaaacggggactaaccggtaacgttagggttagttaaacgtttaaaacggaccgttaaggttcgggcttcggaaccttaaccgttaacg

SEQ ID NO: 435417 - DNA, 571 bp, Homo sapiens
  misc_feature: GZ8MTXP01B90A4.3.88.H11.1.454.CMB.2.raw
  modified_base (251)..(251): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggggtattagcagctggtanctggtatcagcagaaaccagggaaagcccctaaagctcctgactctatgctgctactccatttgctaacgtcggggtcccatccgaggttcaagcgggcgaggggtatcgtgggacaggtattcactctcacgatcagcacgcctgccagcctagtaacgtacgttttggacttaacttacttagtttcgtacaacgtaggtaccttaaacttacgttttaccctttaattccgttacggaccgtaaacgggactacggtacgttacgggagttaacgttaaacgaccggttaagtcggtcgttcgccttaacgttaacg

SEQ ID NO: 435418 - DNA, 568 bp, Homo sapiens
  misc_feature: GZ8MTXP01CFKUI.3.88.H11.1.454.CMB.2.raw
tcagagacgcactccacgaccggtgctcgatttagcgacagcgagaacacacaaaggggggagtcagacccagtcaggacacagcatggacatggagggtccccgctcagctcctggggctcctgctgctctggttcccaggttccagatgcgacatccagatgacccagtctccatcttccgtgtctgcatctgtaggagacagagtcaccatcacgttggtcggggcgagtcaggggtattagcagctggttagcctggtatcagcaagaaaccagggaaacgcccctaaagcctcctgatctatgctgcatcctactttgacaaacgtccggggtcccatccgaggttcgaagcggcgaggggatcgtggggacagtacttcactctcaccatcagcagcctgcacgcccgtaagtacttttacggacttaaactttacttattcgtacaaacgaggtacttaactacgtttaccctttaactccgttaacggaccaaaggggtacacgtaacgtggaagttacttaaacgaagttgtcggctcggacctaaccgttaagttccg

SEQ ID NO: 435419 - DNA, 548 bp, Homo sapiens
  misc_feature: GZ8MTXP01BR2M4.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaacgcccctaaagctcctgatctatgctgcatccactttgcaaactcggggtcccatccaggttcaagcggcaggggatcgtgggacagattcactctcacatcagcagctgcagctagagtattttgactaacttactattgtacaacaggtactaaactacgtttccctttaaatccgtttcggaccgtaaacggggttacaaccggtacgttagggttaagttaattaaaacccggaaagtgttacgggcttacggccgttaacccgtaag

SEQ ID NO: 435420 - DNA, 777 bp, Homo sapiens
  misc_feature: GZ8MTXP01AY9CO.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatcgacccagtcctccatccttccgtgtctgcatcgtgtaggagacagagtcaccatctacgttggtcgggcgagtcgaggggttattagctaggtcgttggttacgccgtaggtatcgagacgaacgaaaccgagggaaaccgacccctaagcctacctgactcgtatcggctcgactacttaccctacgtttacgaaccgtaaacggttcccggggtacccctacgtcccgtaggttccgaaacgggtcgggaacggtacgggggtactcgggtacgggaacgtacgttactttacccacgttcctacctaacctacgtaccgacgtaccgacgtccgtacggaccgtacgtaccgttaagtaacgtttacgttttacgtaacctttaaaccgttttaacgttacgtttaccgtaaccgtaaaccggttaacgttaaccctttaaaccgtttacccgtttttaacccctttaacggttaacccggtttacccgggaacccggtaaacgggttaccgtaaacccggtaaggttaacgggttaacgttaaaaccggtttaaaccggtaaccggttgggttaccggtaccgttacggtaacccgttaacctttaaccgg

SEQ ID NO: 435421 - DNA, 566 bp, Homo sapiens
  misc_feature: GZ8MTXP01EX93J.3.88.H11.1.454.CMB.2.raw
  modified_base (251)..(251): a, c, t, g, unknown or other
  modified_base (387)..(387): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtatagcagctggttagcnggtatcagcagaaacagggaaagcccctaaagctcctgatctatgctgcatccactttgactaaacgtcggggtcccatccgaggttcaaggcggcgaggggatcgtaggggacagtatttcactctacacctaancagacacgcctcgacacgactagtaagttacgtttacgaacttaaacttactagttacgtaacgtaacgagtaccttaaacgttaccgtttacctttaagtcgttacggaacgaaacggacgtaacgtacgttaggaagttaaacgtaaacgtagtgtcgtacttacgtaacgaactaa

SEQ ID NO: 435422 - DNA, 521 bp, Homo sapiens
  misc_feature: GZ8MTXP01EXJGI.3.88.H11.1.454.CMB.2.raw
  modified_base (361)..(361): a, c, t, g, unknown or other
  modified_base (505)..(505): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacttgcgggcagtcagggtatagcagctggtagctggtatcagacaagaaaccagggaaacgccccgtaaagcctcctgatctatgctgcactcctactttgacaaacgtccggggtacccatccgagttcaagcggcgaggggatcgngggacagtattcactctacacatcagcagcctgcagcctagaacgttatttcgactaacttactattgacaagtacgtactaacttacgtttacccttaatcgttacggacgtaacggacacgacgttggattataacgagtgnggcttgccaacgtaac

SEQ ID NO: 435423 - DNA, 641 bp, Homo sapiens
  misc_feature: GZ8MTXP01C9CQO.3.88.H11.1.454.CMB.2.raw
  modified_base (286)..(286): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtccaccatcacgttggtcgggcgagtcgaaggggtattagcagctggtagcgtggtatcagacaagaaaccgagggaaacncccctaaagctcctgactctatgctgcactctactttgactaaaccggtccggggtccctagtcccgtaggttcaacgggcgggcggaggggactcggtaggggactagtacttccactctcaccatcacgctacggcctagcgtacgtccgtaagtaaacgtttacggttttacgaacctttaaaacctttacttagttacggtaactaaacggtaacggtaacctttaaaccgtttaccgttttacccgtttaattaacccggttaccggacgtaaacggggcctaaacggtacgttaggttaacgttaaacgttaaacgaactttgggacgtcgttactccgaacttaaccg

SEQ ID NO: 435424 - DNA, 882 bp, Homo sapiens
  misc_feature: GZ8MTXP01BGN0Z.3.88.H11.1.454.CMB.2.raw
tcagagacgcactccacgaccggtgctcgatttagcgacagcgagaacacacaaagggggagtcagacccagtcaggacacagcatggacatggacgggtccccgctcagctccgtggggctcctgctgctctggttcccaggttccagatgcgacatccagatcgacccagtcctccattccttccgtgtctgctatctggtaggagacagactccacatcacgttggcgggcgtagtcgaggggttatagcagtcgtggttacgccgtggtatacgagaacgaacggaaaaccgaaggggaaacccgtcccctaaaggcccttaccgtagtaacttacgtaatcggtacctcgtacctaacttacccttaacgttttacggaacccgtaaaccggtccccgggggtaccccctaacggttaccccgtaagggttacccgaaaacggggccgggcggtaacggggggtacgttaccgggtacgggggtaacctaacgggtttacttttaaccccgacctttacccgacctaaccgtacttaccgacggacccgtacggtcccgtacgggaccctacggtacccgttaagggttaaacccgtttagggttttttaaccggtaacccctttaaaaccgttttacccgtttaaactttaacccgggttaaaccctaaaacgggttaaacccggttttaaaccctttaaaacccgttttacccgttttttaaccccggttttaaacgttaacccggtttaacccgggaaaccgggtaaacccgggggttaaccaaccgggtaacggttaacgggttaaacgtttaaacgttaaaaccgggtccgttaaggttaccggtaccgttaccgaaccgttaaccccgttg

SEQ ID NO: 435425 - DNA, 679 bp, Homo sapiens
  misc_feature: GZ8MTXP01E31OW.3.88.H11.1.454.CMB.2.raw
  modified_base (202)..(202): a, c, t, g, unknown or other
  modified_base (226)..(226): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatcgacccagtcctccatcttccgtgtctgcatcgtgtagganacagagtcacatcagttggcgggngagtcgaggggttattagcagtcgttggttacgccgtggtactcgaagacaaacggaaaaccgaagggaaaccgcccctaaagcctactagatctagtcgctgctactcctactttcgaaccgtaaacggttccgggtacccctagtacccgtaggttccgaacgggtccggggaacggtacgggggtactccgggtacggggaactacggttacttttaccacttccacctaacccataccgaagcccaacgtcccgtcggaccacgtaccgttaaggtaaacgtttacgggttttacgaaacctttaaactttaccgttattacgtactaaacgtacgtaacttaaaccgttaccgttttaaccttagtaaccgttacggacgtaaacgggacaacgtacgttaggaattaacgttaaaccgagtcggcggtcttacgaaccaacgttaac

SEQ ID NO: 435426 - DNA, 707 bp, Homo sapiens
  misc_feature: GZ8MTXP01ARVC4.3.88.H11.1.454.CMB.2.raw
  modified_base (226)..(226): a, c, t, g, unknown or other
  modified_base (292)..(292): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctggtaggagacagagtcacatcacgttggtcgggngagtcgagggtattagcgagtcgttggtagccgtggtatcgagacaaggaaaccgaagggaaaccncccctaaaggcctacctagatctatcgactgactactcctagtttacgactaaacggtccggtccctagtccgtaggtcgaaggcgggcgaggggtactcggtacgggactaggtactttaccactcctaccaacgtactacgacgaccacgtcccgtagaccgtacgtacccgtaagtaaacgtttacgggttttactaaccttaaactttaaccggttaattacgtaaccgaaacgttacgggttaacctttaaacccgtttaaccgtttttacccctttaaacggttcccgtttaaccggggaacccggtaaacgggttacccgtaacccgggtaagttacgggggttaaaccttaaaacggtttaaacccggtaagtcgggttagtacccgttagtcccttaacgtttccg

SEQ ID NO: 435427 - DNA, 655 bp, Homo sapiens
  misc_feature: GZ8MTXP01EJGWN.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccattcttccgtgtctgctatcgtgtaggagacagacgtcacctatctagttggcgggcgtagtcgagggtatagcagctggtagcctggtatcagacaagaaaccgagggaaactcccctaaagctccgtgactctagtgctgcatcctatttcgactaacgtccgggtacctagtccgtaggttcgaaacggcgggtcggaggggtacgtcgacgggtatacgtactttcacttctacactactcacggaccagtcccgtagacctacggaccttaagggtaaacgtttacgttttacgtaactttaaaccttttacggttaactttacggtaacctaaacgtaaacgggttaccttaaacctttaccgttttacccgtttaaatcccgtttaacggttacgaaacggttacgtaaccggtagttacgttaacgttaaacgttaaacgtacgtggtacggtcttactaacttaacccgttaa

SEQ ID NO: 435428 - DNA, 696 bp, Homo sapiens
  misc_feature: GZ8MTXP01CRB47.3.88.H11.1.454.CMB.2.raw
  modified_base (228)..(228): a, c, t, g, unknown or other
  modified_base (297)..(297): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtcctccatcttcgtgtctgcatctgtaggagacagacgtcaccatctacgttggtcgggngtagtcgtaggggttattagcgtagtcgtggttacgtccgtggtatcagacaagaaaccgagggaaacncccctaagcctactgatctatcgctcgactacttcctaacgtttacgaccgtaaacggttccccggggtacccctacgtacccgtaacgggttaccgaacgggacgggtaaccgggaaggggtacgtaccgggtacggggtaactacgggttactttacccaccttcccttaaccaaccctacgtacccgtaacggaccgaaccggtccgttacgaccgtacgtaccgtaagtaacggtttacttttacggtaacctttaacttaccgttattacgtaacgaacgtaacgtaccttaacgttacgtttaccttaagttccgtacggacgtaacgcgtaacggtcgttagttacgttaaacgttaacgtacgtggtcgacttacgaacgttaacttaacg

SEQ ID NO: 435429 - DNA, 613 bp, Homo sapiens
  misc_feature: GZ8MTXP01A9NK5.3.88.H11.1.454.CMB.2.raw
  modified_base (202)..(202): a, c, t, g, unknown or other
  modified_base (228)..(228): a, c, t, g, unknown or other
  modified_base (260)..(260): a, c, t, g, unknown or other
  modified_base (392)..(392): a, c, t, g, unknown or other
  modified_base (399)..(399): a, c, t, g, unknown or other
  modified_base (411)..(411): a, c, t, g, unknown or other
  modified_base (461)..(461): a, c, t, g, unknown or other
tcagagacgcactccacgaccggtgctcgatttagcgacagcgagaacacacaaaggggggagtcagacccagtcaggacacagcatggacatgagggtccccgctcagctcctggggctcctgctgctctggttcccaggttccagatgcgacatccagatcgacccagtctccatcttccgtgtctgcatctggtagganacagagtccacatcacgttggcgggngagtcgaggggttattagcagtcgtggttacnccgtggtatcgagaccgaacggaaaaccgtaaggggaaaccacccccgtaaagccttacccgtagtactccgtatcgctgctactcctactttcgacgtaacggtccggtcctagtccgaggtcaaggcggngagggtncgtggactagtnttccactctacactatcgagcacgtcctagccagtcctaggtaaccgttntttacgacttaacttacgttatacgtacaacgacgttaccttaacttaccgttttaccttaacgttccgtacggaccggaaacggttcgaaacgtacgttaggttaacttaaacgttaaacgcgttcggtggcttaccgaacttccgtaacg

SEQ ID NO: 435430 - DNA, 550 bp, Homo sapiens
  misc_feature: GZ8MTXP01CO23T.3.88.H11.1.454.CMB.2.raw
  modified_base (347)..(347): a, c, t, g, unknown or other
  modified_base (384)..(384): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggggtattagcagctggtagctggtatcagcagaaaccagggaaagcccctaaagctcctgatctatgctgcatccatttgcaaactcggggtccatccaggttcaagcggcaggggancgtgggacagatttcactctcaccatcagacacgccncgcacgactagtaagtagtttacgtactaacttacttattagtacaacgacgtactaactactttacctttaacttcgtacgttacgaacggaacgaacgtacgttacgttacgttaaacgtaaaacgtaaacgtaagtacggtacgttacgtaaccgaactaacg

SEQ ID NO: 435431 - DNA, 679 bp, Homo sapiens
  misc_feature: GZ8MTXP01CYZ59.3.88.H11.1.454.CMB.2.raw
  modified_base (203)..(203): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatcgacccagtcctccattcttccgtgtctgctatctgtagganacagatcaccatctagttggtcgggcgtagtcgaagggtattagcgagtcgtggtagccgtggtatcagacaaggaaaccgaaggaaacgcccctaaagcctacctgactctatcgctgcactcctacttcgactaacgtccgggtaccctagtccgtaggttacgacggcgggaacgaggggtactcggtagggacacgttacttccaacttctacctaccattccgaacgtacgacgccgttagaccgtacgtaccgttaagtaaagtttacggttttacgaacctttaaactttacgttaacttcggaaacctaacgttaaacggttcctttaaaccgttacctttttaccccgtttaaagtcccggtttaacccggacggtaaacgggaccgtaaacgtccggttaaaggttaaccgttaaagttaaacggtaccgttggtacgggtcttacggtaacccgttaacgttccg

SEQ ID NO: 435432 - DNA, 691 bp, Homo sapiens
  misc_feature: GZ8MTXP01CCI3E.3.88.H11.1.454.CMB.2.raw
  modified_base (263)..(263): a, c, t, g, unknown or other
  modified_base (298)..(298): a, c, t, g, unknown or other
  modified_base (406)..(406): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctggtaggagacagacgtcacctatctacgttggtcgggcgagtcgaggggttattagctagtcgtggttacncgtaggtatcagacaacggaaaccgagggaaaccncccctaagcctcctagtactctagtcgctcgactacttacctacgtttacgaaccgtaacggttccccggggtacccagtcccgtaaggttccgaacgggtaccgggnggaggggtactcgggtacggaaccgtagttacttcaccgttctaccgacctatacgacgaccgtacgccttagaccgacggtactaggttaacgtttacttttacggtaacttaaaccgtttattacgttacgaaccgtaacgtacggttaacctttaacgtttaccttttaaccctttaagtcccggtttaaccggaacggtaaacgggacctaaacggtacgttaagggttaaccttaaagttaaacgacgttggtcggtacttacggtaaccttcgttaacg

SEQ ID NO: 435433 - DNA, 569 bp, Homo sapiens
  misc_feature: GZ8MTXP01DE5LH.3.88.H11.1.454.CMB.2.raw
  modified_base (414)..(414): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggtagcctggtatcagcaagaaaccgagggaaacgcccctaaagctcctgatctaatgctgcactcctactttgactaaaccgtcggggtcccagtccaggttcaagcggcgaggggatcgtagggacagtacttcactctacacatcagcagctgcagcctagtaagtntttcgacttaacgttactaattcgtacaacgtacggtacttaaacttacgtttaccctttaaagttcccttaccggacgtaaacgggacaacgtacgttacgggaattaaacgtttaaaacgacgttggtacggcttacgcccgttaacctaacg

SEQ ID NO: 435434 - DNA, 867 bp, Homo sapiens
  misc_feature: GZ8MTXP01D0DAA.3.88.H11.1.454.CMB.2.raw
  modified_base (201)..(201): a, c, t, g, unknown or other
  modified_base (227)..(227): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatcgacccagtctccatcttccgtgtctgcatctggtagganacagacgtcaccatcacgttgcgggnagtcgaggggtattagctagtcgtaggttacgccgtaggtactcgaagtacgaaacggaaaccggaacgggtaaaccgtaccccgtaaaggtccttaccgtaggtaacttacgttaacgtcgtaccgttcgaccgtacttacccgttaaacgtttacggaaccgttaaaccggttaccccgggggtacccctaacggtttacccggtaacggttaccggtaaacgggaccgggtaacgggtaacgggggtaaccgttaccggggtacggggtaaaccgttaacgggttaccttttaacccgaccgtttaccctaccgtaaacccgtaacgtaccgtaaccgggtacccgtaacggtaccccgtttagggaccgttaaccggtacccgttaaagggttaacgtttaaccggtttttaacgggaacccttttaaaaccgtttaacgttaacgtttaccgtaaccgttaaacgtaacggtttaccctttacccgtaacccctttaccccggttacgttaacccggttaaccgggtttcccggggggaaccgggggttaaccgtaaaggggttacggttaacggttaccgttaaccggaaaacggttacgttcggtacggcgttacgtccgttaaccgttaacg

SEQ ID NO: 435435 - DNA, 501 bp, Homo sapiens
  misc_feature: GZ8MTXP02GNDLI.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagcagaaaccagggaaagcccctaagctcctgatctatgctgcatccactttgcaaactcggggtcccatccaggttcagcgcaggggatctgggacagatttcactctcacatcagcagcctgcagcctgaagattttgctaacttactattcgtacaacaggctaactagtttcctttaatcttacggtacaacgggacacgacgtaggagattaaacgaactagtcggctcgcaccta

SEQ ID NO: 435436 - DNA, 554 bp, Homo sapiens
  misc_feature: GZ8MTXP02F25GV.3.88.H11.1.454.CMB.2.raw
  modified_base (203)..(203): a, c, t, g, unknown or other
tcagagacgcactccacgaccggtgctcgatttagcgacagcgagaacacacaaagggggagtcagacccagtcaggacacagcatggacatggacgggtccccgctcagctccgtggggctcctgctgctctggttcccaggttccagatgcgacatccagatgacccagtctccatcttccgtgtctgcatctggtagganacagagtcaccatcacttggtcgggcgagtcgaaggggtattagcagctggtagcctggtatcagcagaaaccagggaaacgcccctaaagctcctgatctatgctgcatcctactttgactaaacgtcggggtcccacgtccaggttcagcggcgaggggatcgtagggacagtactttcactctcacatcagcagctgcagcctagaagtattttcgactaactttactattactacaaacaggtacttaaactacgttttaccctttaaattccgtttacggacctaaacggggacaacgtacgtaggagtaaagttaaaaccgaatagtacggctacggacacctag

SEQ ID NO: 435437 - DNA, 517 bp, Homo sapiens
  misc_feature: GZ8MTXP02JYB7D.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactcggggtcccatccaggttcagcggcgaggggatcgtgggacagatttcactctcaccatcagcagcctagcagcctgaagtattttgactaacttactattcgtacaacaggactaactagtttacccttaattcttacggacctaaacgggaccacgactaggactaattaaacgacttagtacggctcgacacctac

SEQ ID NO: 435438 - DNA, 514 bp, Homo sapiens
  misc_feature: GZ8MTXP02G3JJP.3.88.H11.1.454.CMB.2.raw
tcagagacgcactccacgaccggtgctcgatttagcgacagcgagaacacacaaaggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggttagcctggtatcagcagaaaccagggaaagcccctaagctcctgatctatgctgcatccactttgcaaactcggggtcccatccaggttcagcggcaggggatcgtgggacagatttcactctcacatcagcagcctgcagcctagaagtattttgctaacttactattcgtacaacaggtctaaactacgtttaccctttaaatctttcggacctaaacggggacaacgactaggactagttaaacgaactagtacgctgacactac

SEQ ID NO: 435439 - DNA, 537 bp, Homo sapiens
  misc_feature: GZ8MTXP02IG76Y.3.88.H11.1.454.CMB.2.raw
  modified_base (371)..(371): a, c, t, g, unknown or other
tcagagacgcactccacgaccggtgctcgatttagcgacagcgagaacacacaaaggggagtcagacccagtcaggacacagcatggacatgagggtcccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagcagaaccagggaaagcccctaagctcctgatctatgctgcatccactttgcaactcgggtcccatccaggttcagcggcgaggggatcgtgggacagatttcactctcacntcagcagcctgcagcctagaaagtattttgactaactttactaatttcgactaacaggacttaactacgttttcccctttaaattccgtttacggacctaaacggggaccaacgacctagggaataagttaaaacgtaaacgtgttagggcctttggccaacctac

SEQ ID NO: 435440 - DNA, 507 bp, Homo sapiens
  misc_feature: GZ8MTXP02IYTCA.3.88.H11.1.454.CMB.2.raw
tcagagacgcactccacgaccggtgctcgatttagcgacagcgagaacacacaaaggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggggtattagcagctggttagcctggtatcagcagaaaccagggaaagcccctaagctcctgatctatgctgcatccactttgcaaactcggggtcccatccaggttcagcggcgaggggatcgtgggacagattcactctcaccatcagcagcctgcagcctgaagtatttgctaacttactattgtacaacaggactaactacgtttccctttaaatcctttcggcctaaacgggacaacgacgtacggagaataaacgaactagtggctcgcactac

SEQ ID NO: 435441 - DNA, 502 bp, Homo sapiens
  misc_feature: GZ8MTXP02G2O2I.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggttagcctggtatcagcagaaaccagggaaagcccctaagctcctgatctatgctgcatcactttgcaaactcggggtcccatccaggttcagcggcaggggatctgggacagatttcactctcaccatcagcagcctgcagcctagaagtattttgctaactttactattcgtcaacaggactaacgatttccctttaatcttcggactaacgggacacgactaggagaataaacgaactgtcggactcgcactac

SEQ ID NO: 435442 - DNA, 518 bp, Homo sapiens
  misc_feature: GZ8MTXP02IZT7B.3.88.H11.1.454.CMB.2.raw
  modified_base (198)..(198): a, c, t, g, unknown or other
tcagagacgcactccacgaccggtgctcgatttagcgacagcgagaacacacaaaggggagtcagacccagtcaggacacagcatggacatgagggtccccactcagctcctggggctcctgctgctctggttcccaggttccagatgcgacatccagatgacccagtctccatcttccgtgtctgcatctgtagganacagagtcaccatcacttggtcgggcagtcaggggtattagcagctggtagcctggtatcagcagaaaccagggaaacgcccctaagctcctgatctatgctgcatcctactttgactaaacgtcggggtcccatccaggttcacgcggcgaggggatcgtgggacagtatttcactctcacatcagcacgcctgcagcctagaagtatttcgactaacttattatgtacaacaggtactaacttacgtttcctttaatcgttcggacaacgggacacgtacgtaggacgtaataaacgactagtacggctacgcaccta

SEQ ID NO: 435443 - DNA, 525 bp, Homo sapiens
  misc_feature: GZ8MTXP02HAEDV.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggttagcctggtatcagcagaaaccagggaaagcccctaagctcctgatctatgctgcatccactttgactaaacgtccggggtaccacgtcctaggttcagcggcgagggggatcgtggacagattcactctcacatcagcagctgcagctagagtatttgactaacttactattgtacaactaggactaactactttaccttaaattcttacggaccaacggggacaacgtacgtacggaagtaacttaaacgaacgtagtaggactcggacaccttac

SEQ ID NO: 435444 - DNA, 545 bp, Homo sapiens
  misc_feature: GZ8MTXP02FPS5P.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggtagcctggtatcagcaagaaaccgagggaaagcccctaagctcctgatctatgctgcatccactttgactaaacgtcggggtcccagtcaggttcagcggcgaggggatcgtaggggacagtatttcactctcacatcagcacgcctgacagcctagaatatttacgactaacttactattcgtacaacagtactaacgtacgtttacctttaatcgttacggacctaaaggggacctaacggtacttagggaagtaacttaaaacggacgttagttacggacgttacgaccacttaac

SEQ ID NO: 435445 - DNA, 575 bp, Homo sapiens
  misc_feature: GZ8MTXP02JPND4.3.88.H11.1.454.CMB.2.raw
  modified_base (356)..(356): a, c, t, g, unknown or other
  modified_base (365)..(365): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtatagcagctggttagcctggtatcagcagaaaccgagggaaagcccctaagctcctgatctatgctgcatcctactttgactaaacgtcggggtcccatccaggttcaggcggcgaggggntcgtggganagtattcactctcaccatcagcacgctcgcacgcctagagtatttagactaactttactattgtacaacgtaggtacttaacgttacgtttaccctttaaacgtttccgttaccggaccgtaaacgggtacctaaccggtacgtacgggtaagtaaacgttaaaaccggtaaccgttaggtacgggtaccttacggacctacccgttaac

SEQ ID NO: 435446 - DNA, 517 bp, Homo sapiens
  misc_feature: GZ8MTXP02G5IGP.3.88.H11.1.454.CMB.2.raw
  modified_base (199)..(199): a, c, t, g, unknown or other
  modified_base (488)..(488): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcagtcgaggggtattagcagctggtagcctggtatcatcagaaaccagggaaagcccctaagctcctgatctatgctgcatcctactttgacaaacgtcggggtcccatccaggttcaggcgcgagggatcgtgggacagatttcactctcaccatcagcacgcctgcagcctagaagtatttcgactaacttactattgtacaacaggtactaactacgtttaccttaattccgttacgacgtaaacggacacgacgtggaanaataaacgactagtacgactgaccactac

SEQ ID NO: 435447 - DNA, 552 bp, Homo sapiens
  misc_feature: GZ8MTXP02G33US.3.88.H11.1.454.CMB.2.raw
tcagagacgcactccacgaccggtgctcgatttagcgacagcgagaacacacaaagggggagtcagacccagtcaggacacagcatggacatgagggtccccactcagctcctggggctcctgctgctctggttcccaggttccagatgcgacatccagatgacccagtctccatcttccgtgtctgcatctgtaggagacagagtcaccatcacttgtcgggcagtcaggggtattagcagcgtggttagcctggtatcagcaagaaaccagggaaagcccctaagctcctgatctatgctgcatccactttgactaaacgtcggggtcccatccagttcagcggcgaggggatcgtaggacagtatttcactctcacatcagcacgctgcagcctagaatatttgactaaacttactattagtacaactaggactaactagtttacccttaatccgttacggtaccgaacgggtaccaacgtaccgtaggtaacgtaaacgttaaaacgtaaaccgtaggtacgggtccttacggacctaacccgtaacg

SEQ ID NO: 435448 - DNA, 543 bp, Homo sapiens
  misc_feature: GZ8MTXP02HCK96.3.88.H11.1.454.CMB.2.raw
  modified_base (199)..(199): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtccaccatcacttgcgggcagtcaggggtattagcagctggtagcctggtatcagcagaaaccagggaaacgcccctaagcctcctgatctatgctgcatcctactttgactaaacgtcggggtacccagtccaggttcaggcgggcgagggggtatcgtagggacagtatttcacttcacaccatcagcagcctgcagctagatagtttgactaacttacttatgactaacagtacttaacgtacgtttacctttaactcgttaccggcgaaacgggtcaacggtacgtacggaagtaattaaaaccggaacttggtacgtcgtacgacctactacg

SEQ ID NO: 435449 - DNA, 534 bp, Homo sapiens
  misc_feature: GZ8MTXP02GPAMX.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagcagaaaccagggaaagcccctaaagctcctgatctatgctgcatccactttgcaaactcggggtcccatccaggttcagcggcgaggggatcgtgggacagatttcactctcacatcagcagcctgcagcctagaacgtattttgactaacttactattgtacaacaggacttaaactacgtttaccctttaaattccttacggacctaaacgggacacgtaccgtaggtaagaacttaaaacgaacgttaggtacggctacggccactaac

SEQ ID NO: 435450 - DNA, 532 bp, Homo sapiens
  misc_feature: GZ8MTXP02JKGWT.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggttagcctggtatcagcagaaaccagggaaacgcccctaagctcctgatctatgctgcatccactttgcaaactcggggtcccagtccaggttcagcggcgaggggatcgtgggacagatttcactctcacatcagcagctgcagcctagaagtatttgtactaacttactattgtacaactaggactaactacgtttacccttaattaccgttacggtccaaacggggacctaacgtaccgtaggaacgtaattaaacgaaacttaggtacggtctacggcactac

SEQ ID NO: 435451 - DNA, 580 bp, Homo sapiens
  misc_feature: GZ8MTXP02HAUOQ.3.88.H11.1.454.CMB.2.raw
  modified_base (199)..(199): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcgagtcgagggtattagcagctggttagcctggtatcagcaagaaaccagggaaacgcccctaagctcctgatctatgctgctatccactttgactaacgtccggggtcccatccaggttcaggcgggcgaggggatcggtaggactagtatttccacttctaccaccatcagtcacgcctgcacgcctagaagttatttacgactaactttattattacgtactaactaggtacttaaacgttacgttttaacctttaacgttccgttaccgggaccgtaaacggggtacctaacggtaccgtagggtaactaaagttaaaaccgtaacgtggttacggacttacgaccactacg

SEQ ID NO: 435452 - DNA, 561 bp, Homo sapiens
  misc_feature: GZ8MTXP02GGOKV.3.88.H11.1.454.CMB.2.raw
  modified_base (199)..(199): a, c, t, g, unknown or other
  modified_base (277)..(277): a, c, t, g, unknown or other
  modified_base (371)..(371): a, c, t, g, unknown or other
  modified_base (428)..(428): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggcgggcagtcagggtattagcagctggtagcctggtatcagcaagaaaccagggaaacncccctaactcctgatctacgatgccctacaagtttgggagggtcgggtccatcgaagttcagcggcagtggatcgtgggactagtagtttaccnctcacctatcgagcagccctgacagcctgatgtacttttgacttaaactttatactntacctaatatttatgttttacctcgttcccgtagggtccgtttacggaccgaaagggtacctaacggggttaagaaacttaccgaaaacgtaacttggtaacggcttacggacctacgtactcgttctttacc

SEQ ID NO: 435453 - DNA, 526 bp, Homo sapiens
  misc_feature: GZ8MTXP02HS1BL.3.88.H11.1.454.CMB.2.raw
  modified_base (199)..(199): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggggtattagcagctggtagcctggtatcagcagaaaccagggaaagacctaagctcctgatctatgctgcatccactttgacaaacgtcggggtacccatccaggttcagcggcgaggggatcgtgggacagatttcactctacacatcagcagcctgcagcctagaagtattttacgactaaactttactattgtacaaacgaggacttaaactacgtttaccctttaaatccgttacggaccgaaacggacacgacgtggaataattaaacgactagtacggctacgacactac

SEQ ID NO: 435454 - DNA, 545 bp, Homo sapiens
  misc_feature: GZ8MTXP02I8ZYB.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagcaagaaaccagggaaacgcccctaagctcctgatctatgctgcatccactttgactaaacgtcggggtcccatccaggttcagcggcgaggggatcgtgggacagtatttcactctcacatcagcagcctgcacgcctagaagtattttcgactaaactttactattcgtacaacaggactaacgtacgtttaccttaaatccgttacggaccgaaacggggacacggtacgtaggaacgtaaacttaaaacgaaacgtcggtaggacttacggacaccctaa

SEQ ID NO: 435455 - DNA, 565 bp, Homo sapiens
  misc_feature: GZ8MTXP02JSYAB.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaagcccctaagctcctgatctatgctgcatccactttgcaaactcggggtcccatccaggttcaggcggcgaggggatcgtgggacaggtatttcactctcaccatcagcagcctgcagcctagaacgtattttcgactaacttactattcgtacaacgtacggacttaacttacgttttaccctttaaattccgttaccggaccgtaaacgggtacctaacggtaacgtacgggtaagtaaacgttaaaacggtaaccgttaggtacggtacttacggacctacttaaccg

SEQ ID NO: 435456 - DNA, 512 bp, Homo sapiens
  misc_feature: GZ8MTXP02HUPNO.3.88.H11.1.454.CMB.2.raw
  modified_base (199)..(199): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcattggcgggcagtcaggggtattagcagctggttagcctggtatcagcagaaaccagggaaagcccctaagcctcctgatctatgctgcatccactttgcaaactcggggtacccatccaggttcaggcggcagggggatcgtggggacagtatttcactctcacccatcagcagccctgcagcctagaatattttgactaacttactatttgacaacgtaggactaaactacgtttacccttaaattcttcggacaacgggacacgactaggaagactaaacgactgagctcgcacta

SEQ ID NO: 435457 - DNA, 520 bp, Homo sapiens
  misc_feature: GZ8MTXP02FYG6P.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagcagaaaccagggaaagcccctaagctcctgatctatgctgcatccactttgacaaacgtcggggtcccatccaggttcagcggcgaggggatcgtagggacagatttcactctcacatcagcacgctgcagcctagaacgtattttgactaactttactattcgtacaacaggtactaactacgtttccctttaaatcgtttacggacaacggacacgactaggaagtaacttaaacgactgtacggctcgacactac

SEQ ID NO: 435458 - DNA, 578 bp, Homo sapiens
  misc_feature: GZ8MTXP02FUVNE.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaacgcccctaagctcctgatctatgctgcatccactttgacaaacgtcggggtcccatccgaggttcacgcggcgaggggatcgtgggacagattcactctcacatcagcagcctgcagcctagaaacgttatttacgactaacttacttattacgtactaaacgacggtacttaaactagtttttacccctttaaattcccgttacggacccgtaaacggggacctaaccggtaacgtacgggtaaagtaaacgtttaaaaccggaaacttggtacgggtaccttacggaccaacccgttaac

SEQ ID NO: 435459 - DNA, 578 bp, Homo sapiens
  misc_feature: GZ8MTXP02G1PSX.3.88.H11.1.454.CMB.2.raw
  modified_base (249)..(249): a, c, t, g, unknown or other
  modified_base (278)..(278): a, c, t, g, unknown or other
  modified_base (344)..(344): a, c, t, g, unknown or other
  modified_base (376)..(376): a, c, t, g, unknown or other
  modified_base (427)..(427): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttancctggtatcagcaagaaaccagggaaacncccctaactcctagactctacgatcgcctcaagtttggagggtcgggtcccagtcaaggtcagcgnaggtggactgtagggactaggtactttactcncacccatcagcaggcctgcagcctgactgtattttgactaaatttattacngaccctaatatttactgttttacctcttccggtaggtaccgttcggaaccgtaaacgggggtacctaaaggggtacggtaaaaactccgtaaaaacggacctttgggaacggtccgttaggacccaccttaacgttcccgttaagtttccc

SEQ ID NO: 435460 - DNA, 510 bp, Homo sapiens
  misc_feature: GZ8MTXP02I5PFJ.3.88.H11.1.454.CMB.2.raw
  modified_base (199)..(199): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcagggtatagcagctggtagcctggtatcagcagaaaccagggaaagcccctaagctcctgatctatgctgcatccactttgcaaactcggggtcccatccaggttcagcggcgaggggatcgtgggacagtatttcactctcaccatcagcacgcctgcagcctagaagtatttgactaacttactattctcaactaggtactactacgtttacctttaatcgttacgcctaacggtacacgactaggacgtattaaacgactgtacggctcgactactac

SEQ ID NO: 435461 - DNA, 532 bp, Homo sapiens
  misc_feature: GZ8MTXP02JSWEI.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtatagcagctggttagcctggtatcagcagaaaccagggaaacgcccctaagctcctgatctatgctgcatccactttgacaacgtcggggtcccatccaggttcagcggcgaggggatcgtgggacagtattcactctacaccatcaagcacgcctcgcacgcctagaagttatttcgactaacttactattgtacaactagacttaactacgtttacccttaagttccgttacggacctaacgggacacgtacgtaggaagaaacttaacgaacgtcggtacgtactacgacactac

SEQ ID NO: 435462 - DNA, 593 bp, Homo sapiens
  misc_feature: GZ8MTXP02J3LVI.3.88.H11.1.454.CMB.2.raw
  modified_base (248)..(248): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtatagcagctggttancctggtatcagcagaaaccgagggaacgcccctaagctcctgatctatgctgctatcctactttgactaaacgtccggggtacccagtccgaggttcaggcggcgaggggactcgtggacagtacttcactctcacatcagcgacgcctgacgacgtcctagtaaacgttatttacgacttaaacttaccttagttacgtaccgtaaacgacggtaccttaaaccgttacgttttaaccccttaagttcccgttaccggacccgaaacggggtaacctaacggtacgtacggtaaacgttaaacgttaaaaccggtaacgtggtacggtactacgacctactacg

SEQ ID NO: 435463 - DNA, 553 bp, Homo sapiens
  misc_feature: GZ8MTXP02FVD7V.3.88.H11.1.454.CMB.2.raw
  modified_base (274)..(274): a, c, t, g, unknown or other
  modified_base (337)..(337): a, c, t, g, unknown or other
  modified_base (343)..(343): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccaggaancccctaagctcctgatctatgctgcatccactttgcaaactggggtcccatcagttcagcggngagggntgtggacagtattcactctcacatcagcagcctagcagcctagaacgtatttgactaacttactattgtacacaggtactaactacgttttacccttaagtccgtttaccggaccgtaaacggggacctaaacggtacgttacgggaacgtaaacgtttaaaaccggaaccgttaggttacggtcgtttacggacctaaccgtttaaccg

SEQ ID NO: 435464 - DNA, 529 bp, Homo sapiens
  misc_feature: GZ8MTXP02HLGPQ.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggttagcctggtatcagcagaaaccagggaaagcccctaagctcctgatctatgctgcatccactttgcaaactcggggtcccatccaggttcagcggcaggggatcgtggggacaggatttcactctcaccatcagcagctgcagcctgaagtattttgactaacttactaattgtcaaacaggtactaactacgtttacccttaaattcttacggcctaaaggggacacgactggtaacgaattaaaaccggaacttacggttggccttaggcctaacctacg

SEQ ID NO: 435465 - DNA, 672 bp, Homo sapiens
  misc_feature: GZ8MTXP02IVC12.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtcctccatcttccgtgtctgcatctgtaggagacagagtcaccatcacttgtcggcagtcagggtattagcagctggttagcctggtatcagcagaaaccaggaaacgccctaagctcctgatctatgctgcatcctactttgactaaaccgtcggggtaccccacgtacccgtacgggtttccgacggtccgggccgggaacgggggtaacgtccggttacgggggaaccgtaagggtaactttttcctaaccgttccctaccaacctactccgaacgaccaaccgtccgtacgaccgacgtaccgtagtaaacgtttagtttacgtacttaaacctttacttacgttacgtaccgaacgtacgtaaaccttacgtttaaccgttttaccttaacgttaccgttaccggaaaccggtaacgggtaaccgtaacggtaccggtaaggtacgtaaaacgttaaacggtaacgttacggtacggtactacggaccctacgttaccg

SEQ ID NO: 435466 - DNA, 593 bp, Homo sapiens
  misc_feature: GZ8MTXP02IUROJ.3.88.H11.1.454.CMB.2.raw
  modified_base (279)..(279): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggggtattagcagctggtagcctggtatcagcagaaaccagggaaacncccctaagctcctgatctatgctgcatcctactttgactaaacgtcggggtacccatccaggttcagcggcgaggggatcgtgggacagtattcactctcacatcagcacgcctgcacgcctagaaagttatttacgaccttaaactttacttaattcgttacaaactacgggtaacttaaacgttacgttttaccctttaaacgttccgtttaccggaccgtaaacggggtaaccaaaccggtacgttacgggaaacgttaaacgttaaaacgtaaccgttaggtacgggtacttacggacctaaccttaacg

SEQ ID NO: 435467 - DNA, 570 bp, Homo sapiens
  misc_feature: GZ8MTXP02JL4B6.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagtcagaaaccgagggaaacgcccctaagctctgatctatgctgacatccactttgactaactcggggtcccagtccaggttcaggcggcgaggggtatcgtagggactaggtatttcaactctaccaccatcagcagcctgacagcctagagttatttcgactaactttacgtattacgtactaacgacggtacttaacgtacgttttaccttaactccgtttaccggctaaacggggtctaaaccggtacgtacggaacgtaacgttaaaacgacgttacgtacgggacttacggaccacgtttaacg

SEQ ID NO: 435468 - DNA, 535 bp, Homo sapiens
  misc_feature: GZ8MTXP02JX4PA.3.88.H11.1.454.CMB.2.raw
  modified_base (199)..(199): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcagtcaggggtattagcagctggttagcctggtatcagcagaaaccagggaaacgcccctaagctcctgatctatgctgcatccactttgacaaacgtcggggtcccagtccaggttcagcggcgagggggatcgtgggacagtactttcactctacaccatcagacagcctgcagcctagaagtatttgactaacttactattcgacaacacggtactaacttagtttaccttaattcgttacgacgaacgggtaccacgacgtacggaagtaactaaacgtaccgtagtacggactaggaccacttacg

SEQ ID NO: 435469 - DNA, 544 bp, Homo sapiens
  misc_feature: GZ8MTXP02GK7J8.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagcctggtatcagcagaaaccagggaaagcccctaagctcctgatctatgctgcatccactttgcaaactcggggtcccatccaggttcaggcggcgagggggatcgtgggacaggtatttcactctcaccatcagcacgcctgcagcctagaagttatttgactaacttacttattcgtacaactaggtactaactacgtttaccctttaatcttacggaccgtaaacgggacctacgtaccgtacggaagtaacgttaaaacgtacgtaggtacggtacgtcgaccacgttac

SEQ ID NO: 435470 - DNA, 603 bp, Homo sapiens
  misc_feature: GZ8MTXP02I6P7L.3.88.H11.1.454.CMB.2.raw
  modified_base (199)..(199): a, c, t, g, unknown or other
  modified_base (435)..(435): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttggcgggcgaggtcgaggggtattagcagcgttggttagccgttggtatcagacaacggaaaaccgagggaaacgacccctaagcctcctgatctatcgctcgcactcctactttcgactaaacgtccgggtccctatccgtaggtcaggcggcgagggatcggtaggactagtacttcactctacacatcacgctacgcctgcacgcctagaagttntttacgactaactttactagttacgtaacgaaacgtaggtaacttaacttacgtttacccttaaacttccgttaacggaccgtaaacgggtaacctaacggtacgtaacgggtaaactaaacgttaaaacggacgttacggtacgacgtacggtaacccacgttaacg

SEQ ID NO: 435471 - DNA, 495 bp, Homo sapiens
  misc_feature: GZ8MTXP02F2KSX.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcagggtattagcagctggttagcctggtatcagcagaaaccagggaaagcccctaaagctcctgatctatgctgcatccactttgcaaactcggggtcccatccagttcagcggcaggggatcgtgggacagatttcactctcaccaatcagcagctgcagcctgaagattttgctacttactattgtcaacaggctaacagtttccctttaaatcttacggccaaagggtacacgactggagataaacgaactgtggactgcactac

SEQ ID NO: 435472 - DNA, 551 bp, Homo sapiens
  misc_feature: GZ8MTXP02ITN9X.3.88.H11.1.454.CMB.2.raw
  modified_base (199)..(199): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcagggtattagcagctggttagcctggtatcagcagaaaccaggaaacgcccctaagctcctgatctatgctgcatccactttgacaactcggggtacccatccaggttcagcggcgaggggatcgtgggacagtatttcactctcacatcagcagcctgcacgcctagtaaagtactttacgactaactttacttattacgtactaacgtacggtacttaacttacgtttaccttaacttcgttacggaccgtaaggaacctacgtacgtacggtaacgtaacgttaaaacgtaacgtacgtacggtactacgacgtactac

SEQ ID NO: 435473 - DNA, 553 bp, Homo sapiens
  misc_feature: GZ8MTXP02FKIE9.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggggtattagcagctggttagcctggtatcagcagaaaccagggaaagcccctaagctcctgatctatgctgcatccactttgacaaacgtcggggtcccagtccaggttcagcggcgaggggatcgtgggacagatttcactctcacatcagcagcctgcagcctagaacgtatttacgactaactttactattcgtacaacgtaggtactaacctacgttttacccttaagtacctttaccggaccgtaaacggggacaacggtaccgttaggaacgtaaacgttaaaacgaaacgttggtacggtctacgacctaccctag

SEQ ID NO: 435474 - DNA, 549 bp, Homo sapiens
  misc_feature: GZ8MTXP02J1LKC.3.88.H11.1.454.CMB.2.raw
  modified_base (201)..(201): a, c, t, g, unknown or other
  modified_base (224)..(224): a, c, t, g, unknown or other
  modified_base (377)..(377): a, c, t, g, unknown or other
tcagagacgcactccacgaccggtgctcgatttagcgacagcgagaacacacaaagggggagtcagacccagtcaggacacagcatggacatggagggtcccccgctcagctcctggggctcctgctgctctggttcccaggttccagatgcgacatccagatgacccagtctccatcttccgtgtctgcatctgtagganacagagtcaccatcattgcgggnagtcaggggttatagcagctggttagcctggtatcagacagaaaccagggaaacgcccctaagcctcctgatctatgctgcatcctactttgacaacgtcggggtcccatccgaggttcaggcggcgaggggtatcgtgggacagtactttcnctactcacatcagcacgctagctacgcctaggaagtatttgactaaactttactattagtactaacgacggttctaacttacgttttaccttaacttccgtacggtaccgaaacgggaccacgtacgtacgaagttaaacgtaacgtaactggtcggtacctgacctactac

SEQ ID NO: 435475 - DNA, 526 bp, Homo sapiens
  misc_feature: GZ8MTXP02HUZ20.3.88.H11.1.454.CMB.2.raw
  modified_base (425)..(425): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcagggtattagcagctggtagcctggtatcagcagaaaccagggaaagccctaagctcctgatcatgctgcatccactttgcaaactcggggtacccatccaggttcaggcgcgaggggatcgtggggacaggatttcactcactacatcagcacgcctagcagcctagaagtattttgactaacttactatgtacaanacgtatttcaacctaccctctctacgtttcgggaccggggtaccgaaggtcgacgtactaacgaaaacgtacgtaggttacggactacggactaccctacg

SEQ ID NO: 435476 - DNA, 524 bp, Homo sapiens
  misc_feature: GZ8MTXP02GOUD7.3.88.H11.1.454.CMB.2.raw
  modified_base (199)..(199): a, c, t, g, unknown or other
  modified_base (288)..(288): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgcgggcagtcaggggtattagcagctggtagcctggtatcagcagaaaccagggaaagcccctaagctccngatctatgctgcatccactttgactaaactcggggtcccatccaggttcagcggcgaggggatcgtggacagtatttcactctcacatcagcagctgcagcctagaatattttgactaacttactattagtacaaactaggactaactacgttttacccttaaattcctttacggactaaacgggactaacgtacgtacggaagtaattaaaacgaactgtggactcgactaccta

SEQ ID NO: 435477 - DNA, 575 bp, Homo sapiens
  misc_feature: GZ8MTXP02HY26K.3.88.H11.1.454.CMB.2.raw
  modified_base (534)..(534): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtcctccatcttccgtgtctgcatctgtaggagacagagtcaccatcacttctcgggcagtcagggtattagcagctggttagcctggtatcagcagaaaccagggaaacgcccctaagctcctgatctatgctgcatcctactttcgacaaacgtccggggtaccccactccgaggttcacggtcgggcgaggggtactcggtgggactaggtatttccaactcacaccagtcagcagcctgacagcctagaagttactttagacttaactttactattacgtacaactacggtacttaacgttacttttaccctttaacgttccttaccgggtaccgaaacgggtaccgacgtacgtagggtaanaacgtttaaaacgaacgtggtacggctcggtactacctacg

SEQ ID NO: 435478 - DNA, 572 bp, Homo sapiens
  misc_feature: GZ8MTXP02FT73J.3.88.H11.1.454.CMB.2.raw
  modified_base (473)..(473): a, c, t, g, unknown or other
  modified_base (562)..(562): a, c, t, g, unknown or other
tcagagacgcactccacgaccggtgctcgatttagcgacagcgagaacacacaaagggggagtcagacccagtcaggacacagcatggacatgagggtccccgctcagctcctggggcctcctgctgctctggttcccaggttccagatgcgacatccagatgacccagtctccatcttccgtgtctgcatctgtaggagacagagtcacaatcacttggtcgggcgagtcgaggggtattagcagctggtagcctggtatcagcaagaaaccgagggaaacgcccctaagctcctgatctatgctgcactcctactttgacctaaacgtccggggtacccagtccgtaggttcacggcgggcgagggggtacttcggacgggactagtactttcaactctaccacatcgagcacgcctgctacgctagtaagtattttacgacttaaactttactatttacgtactaaacgnggtaaccttaacgttacgttttaccttaaacttaccgttcggacgtaaacgggacacgtacgtagaagtaactaaaacgataggtacgntcgactacta

SEQ ID NO: 435479 - DNA, 606 bp, Homo sapiens
  misc_feature: GZ8MTXP02IKSXC.3.88.H11.1.454.CMB.2.raw
  modified_base (196)..(196): a, c, t, g, unknown or other
  modified_base (234)..(234): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgaccagtctcatctccgtgtctgcatctgtagganacagagtcaccatcattgcggcgagtcagggtatagcngctggtagccgtggtatcagacagaaaccgagggaaacgcccctaagctcctgatctatgctgctatcctactttgactaacgtccggggtaccctactccgtacggttcgacggcggcggaggggtactcgtagggactaggtactttcgactctaccacgtactcagcacgtcctacgcacgtccgtagtaagttagtttacgtactaacgtttactaagttcgtaacgtaacgtaacggtacttaaacctttacggttttacccctttaacgtttccgttaccgggtaaccgaaacgggtaacgaaccggtacgtacgtaacgttaaacttaaaacggacttacggtacggactacggactaacgtacg

SEQ ID NO: 435480 - DNA, 555 bp, Homo sapiens
  misc_feature: GZ8MTXP02F46LD.3.88.H11.1.454.CMB.2.raw
  modified_base (199)..(199): a, c, t, g, unknown or other
  modified_base (277)..(277): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcacaatcacttggtcgggcagtcagggtattagcagctggtagcctggtatcagcagaaaccagggaaacncccctaagctcctgatctatgctgcatccactttgacaaacgtcggggtacccatccaggttcagcgggcgaggggatcgtgggacagtacttcactctcacatcagcagctgcagctagaacgtatttcgactaactttactattacgtacaactaggtacttaactacgttttacccttaaattccgttacggactaacggggtactaaccggtacgtaggtaagtaaacgttaaaacgtaacgttaggtacggtacttacggacctaacgttacg

SEQ ID NO: 435481 - DNA, 609 bp, Homo sapiens
  misc_feature: GZ8MTXP02GEK93.3.88.H11.1.454.CMB.2.raw
  modified_base (314)..(314): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttctagatgcgacatccagatgacccagtctccatcttccgtgtctgcatctgtaggagacagagtcaccatcacttggtcgggcgagtcgagggtattagcagctggttagcctggtatcgagacaagaaaccgagggaaaccgcccctaagcctcctgtatctatgctgacnctcctactttgactaacgtccggggtacccagtccgtacggttcgacggcgggcggagggggactcggtaggggactagtactttcacctctaccaccatcagacacgtcagcacgcctaagtacgttatttcgtacttaactttaacttattgtaaccgaactacggtaacttaacttacgtttttaccctttaacttcgttaccggacgtaaacgggactaacggtacgtaacggtaacgttaaattaaaaccggacgttacggtacggtacgttacggaccttaacccttgg

SEQ ID NO: 435482 - DNA, 628 bp, Homo sapiens
  misc_feature: GZ8MTXP02JWWHD.3.88.H11.1.454.CMB.2.raw
  modified_base (199)..(199): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcgaggggtattagcagctggttagcctggtatcagcagaaaccgagggaaacgacccctaagcctcctagatctatgctgcatcctactttcgacaaacgtccggggtccctacgtcctaggttcgacgcgggcgagggggtatcgtggggacagtatttcacttctaccacctatacagcacgcctcgacgacgacctaggtaacgttagttttacgtacctaacgtttacttagtttacgttaaccaaacgtaacggttaccttaaaccgttaccgtttttaccctttaacgtttccgttacccgggaccggtaaacggggtaccgtaacggtaacgtacgggtaacgttaaacgttaaacgtaccgttaggtacggtacgtcgtaccgtaccttaacg

SEQ ID NO: 435483 - DNA, 617 bp, Homo sapiens
  misc_feature: GZ8MTXP02F4QAP.3.88.H11.1.454.CMB.2.raw
  modified_base (203)..(203): a, c, t, g, unknown or other
  modified_base (295)..(295): a, c, t, g, unknown or other
tcagagacgcactccacgaccggtgctcgatttagcgacagcgagaacacacaaagggggagtcagacccagtcaggacacagcatggacatgagggtcccccgctcagctcctggggctcctgctgctctggttcccaggttccagatgcgacatccagatcgacccagtctccattcttccgtgtctgcatctggtagganacagagtcaccatcacgttggtcgggcgagtcgaggggttattagcagtcgtggttagccgtggtatcgagacaagaaaccgaagggaaacnccccgtaagcctcctagactctatcgctcgctactacctactttacgaccgtaaacgtccggggtaccctacgtccgtacggttcgacggcgggcgggtaggggtactcggtacgggactaagtactttacctactcctaccacctatcagacacgctgcacgctagattatttagacttacttactatacgtacaacgtacgtaacttaacttaccgttttaccttaacgttccgttacggaaccgtaaacgggactaacggacgttaaggaacttaaaacgtaaaacggtacgttaggtacggtacctacacctactacg

SEQ ID NO: 435484 - DNA, 561 bp, Homo sapiens
  misc_feature: GZ8MTXP02II5HG.3.88.H11.1.454.CMB.2.raw
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggggtattagcagctggttagccgtggtatcagacaagaaaccgagggaaacgcccctaagcctcctgactctatgctgctatcctactttgactaaacgtcggggtaccccatccgtaggttcacggcggcggaggggactcggtagggacagtactttcacttcaccacatcagcacgctgacagcctagtaagttatttcgactaactttacgtacttcgactaagtacgtaacttaacttacgttttaccttaattccgtacggaccgtaacggacacgtacgtaggtaataaacgtaaacgtacgtagtcggctacgactacgtac

SEQ ID NO: 435485 - DNA, 633 bp, Homo sapiens
  misc_feature: GZ8MTXP02IHXNK.3.88.H11.1.454.CMB.2.raw
  modified_base (207)..(207): a, c, t, g, unknown or other
  modified_base (405)..(405): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatcgacccagtcctccattcttccgtgtctgcatctgtaggagacagngtcaccatcacttggcggcagtcagggtattagcagctggtagcctggtatcagcaagaaaccgaggaaacgcccctaagctcctgatctatgctgctatcctactttgacaactcggggtacccatccaggttcaggtcggcgagggggactcggtagggactaggtactttcgaacttctaccaaccgatcgaacncaacgcccgtacgaccgtacgccgtaaggtaaagttaactttttcggaacttaaactttacgttacttcgtaactaacgtaggtaaccttaacgttacgttttaccctttaattacccgtttacggaaccgtaaacgggtaacctaacggtacgtaacgggtaaacgttaaacgttaaaaaccggtaaacgttacggttacggtacgtacggtacctaaccgttaacg

SEQ ID NO: 435486 - DNA, 603 bp, Homo sapiens
  misc_feature: GZ8MTXP02H3ANO.3.88.H11.1.454.CMB.2.raw
  modified_base (200)..(200): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtcctccatcttccgtgtctgcatctgtagganacagagtcaccatcacttggcgggcgagtcaggggtattagcagctggttagcctggtatcagcagaaaccgaggaaacgcccctaagctctgatctatgctgctatccctatttcgactaaacgtcggggtaccccagtcccacgggttcaggtccgggcgaagggggtactcggtagggacctagtactttccaacttctaccaccaagtccagacacgtcctagctacgctaaggtaagttacttttcgacctaactttacctagttacggtacaaacgtacggtacttaaacgtacgttttaccctttaaacgtcgtttaccgggaacctaacgggacaacgtacgtacggtaagtaacgttaaaacgtacgtaggtcggtacttacggacctactacg

SEQ ID NO: 435487 - DNA, 703 bp, Homo sapiens
  misc_feature: GZ8MTXP02J0N0Q.3.88.H11.1.454.CMB.2.raw
  modified_base (200)..(200): a, c, t, g, unknown or other
  modified_base (255)..(255): a, c, t, g, unknown or other
  modified_base (286)..(286): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctggtagganacagagtcaccatcacttggtcgggctagtcgaggggttatagcagtctggttanccgtggtatcagacaagaaaccgagggaacncccctaagcctctagactctatgctgctactcctacttcgacgtaaccgtccggggtaccctagtccgtaggttcgacggtcgggcggaggggtacttcggaggaacgtagttactttccaaccgttccaccgaacctactacgacgaccgtaccgtccgtacgacctacggtaccgttaaggtaaaggtttacttttacggaacctttaaacgtttacttaacgtttacgaaaccgttaaacgtaacggttaaccttaaaccgttttaccgttttaaccccgtttaaacgtttcccggtaccgggaaaccggtaaacgggtaaaccctaacgggtaaccggtaacgggtaaaacgttaaaacgtttaaaaccggacgttacggtacgggtaaccttacggaacccgtactttaacg

SEQ ID NO: 435488 - DNA, 604 bp, Homo sapiens
  misc_feature: GZ8MTXP02F6NFL.3.88.H11.1.454.CMB.2.raw
  modified_base (199)..(199): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcaggggtattagcagctggttagcctggtatcagcaagaaaccagggaaacgccccaagctcctgatctatgctgcactcctacttgaccgtaacgttccggggtaccccatccgtaggttcacggcgggcgagggggactcggtaggacctagtacttacaccttctaccaaccatacacgcacgccgtacgccgtacgacctagaaacgttacttttacgaaccttaaacctttaaacttagtttacgtaccgtaaacgtaacggtaaccttaaaccgttaaccgtttttaacccttaacttccgttacccggacgaaacggtacacgtacgtacggaataaacgtaaacgatcggtcgactcgacctactacg

SEQ ID NO: 435489 - DNA, 696 bp, Homo sapiens
  misc_feature: GZ8MTXP02F6JGT.3.88.H11.1.454.CMB.2.raw
  modified_base (200)..(200): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccattcttccgtgtctgcatctgtagganacagacgtcaaccattcacgttggtcgggcgagtcaaggggttattagcagcgtggttagcctggtatcgagacaagaaaccgagggaaaccgcccctaagctccgtgattctatgctgactactcctacgtttcgacgtaaaccgtccggggtacccctagtaccgtacggttacgacgggtcgggacggtagggggtacttaccggtacggggtaacgtaacggttacttttaccctaaccttcccgtttacccaaaccctaacgttacctaacggtacccacggtccgtacgtaccgacgtacccgttaagggtaaactttacgtttttacgtaaccttaaacgttttaacttacgttactaacgtaaacgtacgttaaccttaactttaccgttttaccttaacgttccgttacggaccgtaaacgggacaacggtacgtaggaaacgttaacgtaaacgtaacgtggtacgtacgttacgacctacgttac

SEQ ID NO: 435490 - DNA, 565 bp, Homo sapiens
  misc_feature: GZ8MTXP02I5BJ7.3.88.H11.1.454.CMB.2.raw
  modified_base (200)..(200): a, c, t, g, unknown or other
  modified_base (259)..(259): a, c, t, g, unknown or other
  modified_base (280)..(280): a, c, t, g, unknown or other
  modified_base (287)..(287): a, c, t, g, unknown or other
  modified_base (402)..(402): a, c, t, g, unknown or other
  modified_base (434)..(434): a, c, t, g, unknown or other
tcagagacgcactccacgaccggtgctcgatttagcgacagcgagaacacacaaagggggagtcagacccagtcaggacacagcatggacatgagggtcccccgctcagctcctggggctcctgctgctctggttcccaggttccagatgcgacatccagatgacccagtctccatcttccgtgtctgcatctgtagganacagatcaccatcacttggtcgggcagtcgagggttatagcagcgtggtacgctggtancagacaagaaacgaaggaacnccctaanctctagactactatgctagctacgtcctactttgacgtaaacgtccgggtacccagtcctaggttcgaggcggcgaggggtctcggtaggactagttacttcaactctacacctntacagacacgctgccagcttaagagttattanaactaacctttatatttacgacaactacggtaacttaacttacgtttaccttaagtccgttacgacgaaacggaccaagtacgtaaggaactaaacgtaacgtacgtagtacggactacggactacttacg

SEQ ID NO: 435491 - DNA, 565 bp, Homo sapiens
  misc_feature: GZ8MTXP02I6KOE.3.88.H11.1.454.CMB.2.raw
  modified_base (203)..(203): a, c, t, g, unknown or other
  modified_base (254)..(254): a, c, t, g, unknown or other
  modified_base (285)..(285): a, c, t, g, unknown or other
  modified_base (363)..(363): a, c, t, g, unknown or other
  modified_base (369)..(369): a, c, t, g, unknown or other
tcagagacgcactccacgaccggtgctcgatttagcgacagcgagaacacacaaagggggagtcagacccagtcaggacacagcatggacatgagggtcccccgctcagctcctggggctcctgctgctctggttcccaggttccagatgcgacatccagatgacccagtcctccattccttccgtgtctgcatctgtagganacagagtcaccatcacttggcgggcgagtcgagggtatagcagtctggtancctggtatcagacaagaaaccgagggaaacncccctaaagcctctgatctatgctgcatccactttcgactaacgtcgggtacccatccgaggtcacggcgcgagggtntacggnggacagtacttcactctacacctatcagtacagtcctgacacgcctagtaacgttatttacgacttaaactttacgttactacgtaaccaacgtacgtaacttaacttacgttttaccttaagttccgtaccggtacgaaacggtacacgtacgtaggactaaactaacgaactgttacggactcgaccgtactag

SEQ ID NO: 435492 - DNA, 699 bp, Homo sapiens
  misc_feature: GZ8MTXP02H4K9H.3.88.H11.1.454.CMB.2.raw
  modified_base (199)..(199): a, c, t, g, unknown or other
  modified_base (374)..(374): a, c, t, g, unknown or other
tcagagacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttggtcgggcgagtcgaggggttatagcagcgtggttagcctggtatcagacaagaaaccgaagggaaacgcccctaagcctcctgactctatcgctgactactcctactttcgactaaacgtccggggtacccagtcccgtaggttcgaggccgggnggaacgggggtactccggtaggggaacctaggtacttttaccgaccttctacccaccctagtacccgaagtccgacgtcccgttcgaccgtacgtacccgttaaggtaaacggtttactttttacggaacctttaaaacctttacgtttaacgttacgtaacctaaacgtaacggtaacttaaaccgtttacgtttttaacccccgttttaaacgttcccgttaacccgggtaaccgtaaaacggggtaccctaacggttaacgtacggtaacgtaaacgttaaaacgtaacgttacggtacggacgtaccgtactaacctaacg

SEQ ID NO: 435493 - DNA, 733 bp, Homo sapiens
  misc_feature: GZ8MTXP02FU8ZF.3.88.H11.1.454.CMB.2.raw
  modified_base (207)..(207): a, c, t, g, unknown or other
  modified_base (312)..(312): a, c, t, g, unknown or other
tcagagacgcactccacgaccggtgctcgatttagcgacagcgagaacacacaaagggggagtcagacccagtcaggacacagcatggacatgagggtcccccgctcagctccgtggggctcctgctgctctggttcccaggttccagatgcgacatccagatcgacccagtcctccattccttccgtgtctgctatcgtgtagganacagagtccacctatctacgttggtcgggcgtagtcgaggggttattagcgtagtcgttaggttacgccgtggtactcgagacaacggaaaccgaagggaaaccnccccgtaagcctacgtgacttctatgtctagctactaccgtacgttacgaaccgtaacggttccccgggtacctacgtaccgtacggtacgacggtcgggacgggtacgggtacgtaccgggtacgggtaacgttaggttaaccttttacccgaacccgtttccctaaacccgtacccaaagttccgaacggtacccaaccggtccctacgacgtaccgtaccgttaaagttaacgtttaacgtttaccaactttaaccgtttacttagttaccgttaacgaacggtaaccgttactttaaccgtttaaccttttacccgtttaacgtaccggttaccggaacggaaacggtaccgaacggtcgtaaaggtaacttaaaacgtaacgtacgttaggtacgacgtacgtacctaacgtttcg

SEQ ID NO: 435494 - DNA, 718 bp, Homo sapiens
  misc_feature: GZ8MTXP02FMJVA.3.88.H11.1.454.CMB.2.raw
  modified_base (201)..(201): a, c, t, g, unknown or other
tcagagacgcactccacgaccggtgctcgatttagcgacagcgagaacacacaaaggggggagtcagacccagtcaggacacagcatggacatgagggtcccccgctcagctcctggggctcctgctgctctggttcccaggttccagatgcgacatccagatgacccagtctccatcttccgtgtctgcatctgtagganacagatcaccatcacttggcgggcgtagtcgaggggttattagcagtctggttagccgtggtatcagacaagaaaccgaagggaaaacgaccccgtaagctccctagtattctaatgctagccacgttcctacttacgacgtaaacgtccggggtacccctaagtacctaggttacaggcggtcgggagggactcggtagggactagtactttacctactccttacccaccctaacgtcaacgcgtaacgtccgttcgaccgaacgtaccttaaggtaaacgttaacgtttttacgtaaaccttaaacctttttaaacgttagtttaaccgtaaacgtaacaaacgggtttaacccttaaaccgtttaacgtttttacccctttaaaacggtttcccgttaaccggggtaaccgtaaaacggggaaacccttaaacggtaaccgttaagggaaaccgttaaaacgttaaaaaccgttacgttacggacggtaccgtttacggaacgtaacccttaac

SEQ ID NO: 435495 - DNA, 541 bp, Homo sapiens
  misc_feature: GZ8MTXP01BO1T3.45.38.D05.1.454.CMB.2.raw
  modified_base (300)..(300): a, c, t, g, unknown or other
  modified_base (515)..(515): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccacagtgatgttgggtattttagtttgtctctggtaccaacaacacccggcgaacgccccaaactaatcatttanaggacactaagcggcctcgggggttcaagtcgcttctctgctcaagtcctggcaacacggcctccctgcatctctgggctcaggctcagacgaggctgattatttctgttgctcatatgcgagggaccagcgacgttgggtcgttcgggcgggtagggacccgtaggttcgaaccggtctaggttcacgcccgaaggcttcgccccgttcggtcnctctcgtccccgccctccgttcgtcg

SEQ ID NO: 435496 - DNA, 636 bp, Homo sapiens
  misc_feature: GZ8MTXP01C1ON2.45.38.D05.1.454.CMB.2.raw
  modified_base (229)..(229): a, c, t, g, unknown or other
  modified_base (299)..(299): a, c, t, g, unknown or other
  modified_base (452)..(452): a, c, t, g, unknown or other
tcagacgcgatcgacacgaccggtgctcgatttagtatctgatagttggggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcacatggcctgcactggaaccangtgatggttgggtatttttagtttgtctctggtaccaacaacaccccggcaacgccccaaatatcattanaggacactaagcggccctgggggttcagtcgcttctctggctccgaagtccctgggacaacgaccggcccttacccagaacctaaatcctacgtcggggcctccgagggccctacgagggaccgaggtctagtagtttatttcgtgttgcttnatagtcgacggtacgggaccagtcgtacggttggggtcggttcgggacggggacgggtaccgtacgggttccggacccgttcgtaacgggttccgaacggccccgtaaaggcccgttccggttcccccgttcggttaacctaccgttccgttcccgttccccgttccccttccttcccgtccgg

SEQ ID NO: 435497 - DNA, 543 bp, Homo sapiens
  misc_feature: GZ8MTXP01EPL20.45.38.D05.1.454.CMB.2.raw
  modified_base (227)..(227): a, c, t, g, unknown or other
  modified_base (296)..(296): a, c, t, g, unknown or other
  modified_base (505)..(505): a, c, t, g, unknown or other
  modified_base (518)..(518): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatgcctgcactgaaccaanagtgatgttgggtattttagtttgtctctggtaccaacaacacccggcaagccccaaataatcatttanagggacactaagcggccctcgggggtttcaagtcgcttctctggctccaagtcctggcaacacggccctccctgaacaaatctctgggcctcgaggctcaggacgaggctgatttatttctgttgcttcatatgcgagggaccagcgtacgttgggtgttcggacggtaggccgtagggttcgaccgtcgtaggttcacgccgaaggcncgccccttggccnctctcgtccccacctccttcgtccg

SEQ ID NO: 435498 - DNA, 548 bp, Homo sapiens
  misc_feature: GZ8MTXP01A3SN8.45.38.D05.1.454.CMB.2.raw
  modified_base (227)..(227): a, c, t, g, unknown or other
  modified_base (358)..(358): a, c, t, g, unknown or other
  modified_base (368)..(368): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggagttatacttgtctctgaccaacagcaccaggcaaacgcccccaaatcatgatttatgaggcagtaagcggcctgaggggtttctaatcgcttctctggctccaaagtctggcaacncggccctccngacatctctgggctcgaggctaggacggacgaggctgaattattactggctgctactatatgacgtaggttagtagttacgtttgggtcggttcgggcggacggggtacaagtccgtacgacccgttcgttacggtcacggtaacccgaacggtccttccggtcccccgttcggtaaccc

SEQ ID NO: 435499 - DNA, 553 bp, Homo sapiens
  misc_feature: GZ8MTXP01C45L3.45.38.D05.1.454.CMB.2.raw
  modified_base (229)..(229): a, c, t, g, unknown or other
  modified_base (281)..(281): a, c, t, g, unknown or other
  modified_base (297)..(297): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttgggtagttttagtttgtctctggtaccaacacacccgcgaacnccccaaatatcattanaggacactaagcggcctgggggttcagtcgcttctctgctcaagtcctggacaacgaccgccctaccctgaacaatctcgtgggcctccgagctcgaggacgaggctgattatttctgttgctcatatgcgagggaccagcgtacgttgggtcgttcgggcgggagggtaccgtagggttcgaccgtcgtaggttcacgcccgaaggcttccgccccttcggtccactccttcgttccccacccttccttcgtccg

SEQ ID NO: 435500 - DNA, 560 bp, Homo sapiens
  misc_feature: GZ8MTXP01CDYAB.45.38.D05.1.454.CMB.2.raw
  modified_base (229)..(229): a, c, t, g, unknown or other
  modified_base (296)..(296): a, c, t, g, unknown or other
  modified_base (533)..(533): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttgggtatttttagtttgtctctgtaccaacaacacccgcaacgccccaaatatcattanaggacactaagcggcccgtcgggggtttcagtcgcttctctgctccaagtcctggcaacgaccggccctccctgaacaatcctcgtcgggctccaggctcgaggacgaggctgtatttatttctgttgctcatatgacgagggaccagctacgtttggggtcgttcgggcgggacgggtaccgtagggttcgaccgtcgtaggttcacggcccgaaggcttccgccccttcggtccnctccgtcgtcccgccctccttcgtccg

SEQ ID NO: 435501 - DNA, 536 bp, Homo sapiens
  misc_feature: GZ8MTXP01BMI2Y.45.38.D05.1.454.CMB.2.raw
  modified_base (297)..(297): a, c, t, g, unknown or other
  modified_base (525)..(525): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtattttagtttgtctcctggtaccaacacacccggcaacgccccaaatatcattanaggacactaagcggcctcgggggtttcaagtcgcttctctggctcaagtcctggcaacacggccctccctgaacaatcctctgggcctccaggctcaggacgaggctgatttatttctgttgctcatagtgcggggggacagcacgttgggtgttcggcggagggccgtaggtcgaccgtcgtaaggtcacgcccaaggcctcgccccgttggttcctctctcgttcncgatcgcgtcg

SEQ ID NO: 435502 - DNA, 560 bp, Homo sapiens
  misc_feature: GZ8MTXP01AI2JX.45.38.D05.1.454.CMB.2.raw
  modified_base (228)..(228): a, c, t, g, unknown or other
  modified_base (303)..(303): a, c, t, g, unknown or other
  modified_base (332)..(332): a, c, t, g, unknown or other
  modified_base (536)..(536): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatggttgggtagttttagtttgtctcctggtaccaacaacacccggcgaacgccccaaactaatcatttanaggacactaagcgcctgggggttcagtcncttctctgctcaagtcctggcaacgacggccctaccctgaaccaatctctgggcctccgagggctcgaggacgaggctgatttatttctgttgcttcatatgcgtagggaccagcgtacgttgggtcgttcgggcggagggtccctagggttcgacccggtcgtaacggttcgagcccgaaggccttccggccccttcggtccnctcctcgtcccgcctccttcgtcg

SEQ ID NO: 435503 - DNA, 594 bp, Homo sapiens
  misc_feature: GZ8MTXP01EM782.45.38.D05.1.454.CMB.2.raw
  modified_base (211)..(211): a, c, t, g, unknown or other
  modified_base (284)..(284): a, c, t, g, unknown or other
  modified_base (403)..(403): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctnacttgcagtgtctctggtgactccatcagtagtagtcataatttgggctggtcgcagcccccagggaagggcnggagtggattgggactgtctactctagtgggaccacctattacacgcccgtcctcaagcctcgactggtgatctacaataaacacgtaccaagaaccaattctccctgagctgaactcngtcgaccgcgcgacacggcaaagtcttacgtgtgaccaaggagacgggtcctagggtaaatttactccgtttacgaaccctcggtaagggggtcccttagggggtaaaccccttgggtccaacccggttcttcccgttaccgaacgtccctaacccgacgaaccgggcccctaacgttcccgggtttcccc

SEQ ID NO: 435504 - DNA, 591 bp, Homo sapiens
  misc_feature: GZ8MTXP01DYBBU.45.38.D05.1.454.CMB.2.raw
  modified_base (456)..(456): a, c, t, g, unknown or other
  modified_base (489)..(489): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcacttgcagtgtctctggtgactccatcagtagtagtcaattaaagttttggggctgggtcccgccgacgcccccgaggggaaaggggctgggagtggattgggactgtctactctagtgggaccacctattacagcccgtcctcaacgacctcgactggtcatctacaattaaaacacgtacccaaagaaccaattctccctgagctgaactctgtacgacccgcgcgggacacggaccaaatnttacgtgtgacaagagacgggctggaaactttntcctttagacctacgtggggcccttaggggaaccccttgggtccaccggttcttccttcgaagcccttccgaaccgacgggccctaacgttccggttccccg

SEQ ID NO: 435505 - DNA, 572 bp, Homo sapiens
  misc_feature: GZ8MTXP01DVV6P.45.38.D05.1.454.CMB.2.raw
  modified_base (227)..(227): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcatcaccatggcctgcactggaaccanagtgatgttgggattataacttgtctctgtacaacagcaccagcaaacgcccccaaactcatgatttatgaggcagtaagccgcctcgagggtttactaatcgtcttcctctggctcaagtcctaggcaacaccggtccctccctagacaactctcgtggcctccgagctggaggtacgaggtctagtattacttacgtgtctagtctactatagtgcgtaaggttacgttaggttacgtttggtggttcgggaacggtaacgggaccgtaagttccgtacgtaccggttccgttacggttacaaccggccgaacggtccgtccgccccgttcggttaactcccg

SEQ ID NO: 435506 - DNA, 639 bp, Homo sapiens
  misc_feature: GZ8MTXP01DY09N.45.38.D05.1.454.CMB.2.raw
  modified_base (211)..(211): a, c, t, g, unknown or other
  modified_base (230)..(230): a, c, t, g, unknown or other
  modified_base (266)..(266): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctnacttgcagtgtctctggtnactcatcagtagtagtcataaatttgggctggtccncagcccccagggaagggctggagtggagtggactgtctactctagtgggaccacctattacacgcccgtccctcaacgaccctcgactggtgatctacaataaacacgtaccaaagaacctaaattctaccctgaggctagaactctagtcgaccgccgcggaacacggaccaaaatacttaacgtgtacgacaaagacgacgggtacctagggtaaactttactccttttacgaaccctaacggttcggggacccgttacgggggaaaccccttggggtacctaacccggttccgttcccttaccgtaaccggccccttaacccgaaccccggaaacgggggccccctaacggttcccggggtttccccccg

SEQ ID NO: 435507 - DNA, 580 bp, Homo sapiens
  misc_feature: GZ8MTXP01E2DKH.45.38.D05.1.454.CMB.2.raw
  modified_base (227)..(227): a, c, t, g, unknown or other
  modified_base (302)..(302): a, c, t, g, unknown or other
  modified_base (338)..(338): a, c, t, g, unknown or other
  modified_base (528)..(528): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatggcctgcactggaaccangtgatgttgggtattttagttgtctctaggtaccaacaaccaccccggacgaacgaccccaaataactcatttanaggacactaagcgccgtcgggggttcagtcgcttcnctgctcaagtcctaggcaacgcgccctaccctgaacaatctcgtcgggcctcgagggcctacgacggacgagggcttaggtatttactttcgtggttcactctaagtatcgcggacgggaccagctacgttgggtgtcggcggacggtcgtaggtcgaccgtccgtaggttcacgttcccgaaggtcccncggcccccttggtccaccttccgtacccgttccccaccccttccgttcgtcg

SEQ ID NO: 435508 - DNA, 664 bp, Homo sapiens
  misc_feature: GZ8MTXP01D6ZEY.45.38.D05.1.454.CMB.2.raw
  modified_base (157)..(157): a, c, t, g, unknown or other
  modified_base (224)..(224): a, c, t, g, unknown or other
  modified_base (283)..(283): a, c, t, g, unknown or other
  modified_base (289)..(289): a, c, t, g, unknown or other
  modified_base (437)..(437): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttntgccctgactcagcctgcctcgtgtctggtctcctggacagtcgatcaccatgctgcactgaaccangtgatgttggtattttagtttgtctctggtaccaacacacccggcaacgccccaaatancattanaggacacaagcggccgtgggggttcagtcgtctctcttggctacgaagtcctggcaacgaccggccctaccctagaactaatccgtactcgggcctccagggtcctacgaggtaccgaggcctagtatttactttctgttgtccttanattaatcggacgaacgggggaccaacggtaccgtaacgttcgggggtcggttacggggaccgggtacggggtacccgttaggggttccggtacccggttaacccgtaagggttccgaacgggttcccgaaacggggtccttcccggttccccccgttaggggttcccaacccgtttccttacccgggttaccccccttaccccggttccccttcccgttaacccggg

SEQ ID NO: 435509 - DNA, 520 bp, Homo sapiens
  misc_feature: GZ8MTXP01EL2B9.45.38.D05.1.454.CMB.2.raw
  modified_base (227)..(227): a, c, t, g, unknown or other
  modified_base (400)..(400): a, c, t, g, unknown or other
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaangtgatgttgggattttagtttgtctctggtaccacacacccgcaacgccccaaactcatgatttatgaggcagtaagcggccctcaggggtttctaatcgcttctctggcctccagtctggcaaacacgcctcctgacatctctgggctcagctgagcgaggctgattatacngctgctcgatatgctaggtagtagttacgtttgggtgtttcgggcgggtagggacccaagcttgaccgttcgtaggtcacgcccaagggctcgcccctcggtccacgtcttcgttccccc

SEQ ID NO: 435510 - DNA, 551 bp, Homo sapiens
  misc_feature: GZ8MTXP01DNKDB.45.38.D05.1.454.CMB.2.raw
  modified_base (229)..(229): a, c, t, g, unknown or other
  modified_base (301)..(301): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttgggtatttttagtttgtctctggtaccaacaacaccccggcaacgcccccaaatatcatttanaggacactaagcggccctgggggtttcaagtcgcttctctgctcaagtcctggcaacacggccctccctgaacaatctctgggcctccaggctcgaggacgaggctgtatttatttctgttgctcatatgcgagggaccagcgtacgttgggtgttcgggcgggagggtaccgtagggttcgaccgtccgtaggttcacgcccgaaggccttcgccccttcggtcactctcgtcccgccctccttcgtcg

SEQ ID NO: 435511 - DNA, 600 bp, Homo sapiens
  misc_feature: GZ8MTXP01D8IU2.45.38.D05.1.454.CMB.2.raw
  modified_base (226)..(226): a, c, t, g, unknown or other
  modified_base (296)..(296): a, c, t, g, unknown or other
  modified_base (360)..(360): a, c, t, g, unknown or other
  modified_base (539)..(539): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatggcctgcactggaaccanagtgattgttgggtatttttagtttgtctctgtaccaacaacaccccgcaacgccccaaatatcaattanaggacactaagccggtccgtcggggtttcaagtcgcttctctcgctccaagtccctggacaacnccggccctaccctgaacaaatctcgtcgggcctccgaggcctcgaggacgaggctagtatttagtttctgttgctacattagtgacgagggaccagcgtacgttggggtcgttcgggacgggacgggtacccgtagggttcgacccggtccgtaggttcgaacgcccgaacgggtcccncggttccccccgttcggtcctaccgttcccgttcgttccccgcccttcccgttcgttcccg

SEQ ID NO: 435512 - DNA, 642 bp, Homo sapiens
  misc_feature: GZ8MTXP01DC43Y.45.38.D05.1.454.CMB.2.raw
  modified_base (232)..(232): a, c, t, g, unknown or other
  modified_base (360)..(360): a, c, t, g, unknown or other
  modified_base (378)..(378): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtcccctcacttgcagtgtctctggtnactccatcagtagtagtcattaagtttggggctgggtccgccacgcccccgaggggaacgggctggaggtggagttgggacttgtctacgtcgtaggtcgggacctaccttatacacgtccccgtccncaacgccctcgactggtnatactacaataaacacgtaccaaagaaccaattcaccctgacggcttagaactcgtacgtacgacccggccgacggaccaacggaccctaaaagttacttacgtacgtgaccaaaggaggcgggccttaggtaaactttcgtcctttacgacctacggttcgggggcccgttacggggaacccttggtacccacccggttccttcccgttacaaccggtccctcccgaacccgacggggcccctaacgttcccgggtttccccc

SEQ ID NO: 435513 - DNA, 606 bp, Homo sapiens
  misc_feature: GZ8MTXP01ADN56.45.38.D05.1.454.CMB.2.raw
  modified_base (157)..(157): a, c, t, g, unknown or other
  modified_base (227)..(227): a, c, t, g, unknown or other
  modified_base (287)..(287): a, c, t, g, unknown or other
  modified_base (417)..(417): a, c, t, g, unknown or other
  modified_base (421)..(421): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttcngccctgactcagcctgcctccgtgtctggtctcctggacagtcgatcaccatggcctgcactggaaccangtgatgttgggattttgtttgctctgtaccaacacacccgcacgccccaaatatcattanaggacactaagcggtcctgggggtttcagtcgcttctctggctccaagtcctggcaacacggcctaccctgaacaactctcgtcgggcctcgaggcctacgacggacgaggctagtatttacttctgttncttnatagtgcggagggaccagcgtacgttggggtgttcgggacgggacgggtaccgtaggttcggaacccggttccgtacggttccgaacggcccggtaaacgggtcccgttcccggttccccccgttcgggtccctacccgttccgttcccgttcccccggttcccttaacccgttccgttcccggg

SEQ ID NO: 435514 - DNA, 596 bp, Homo sapiens
  misc_feature: GZ8MTXP01C18P4.45.38.D05.1.454.CMB.2.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcgatcaccatggcctgcactaggaaccaacagtgatggttgggtattttagtttgtctctggtaccaacaacaccccggcaacgaccccaaactaatcattataggacactaagcggccgtcgggggttcaagtcgctctctggctcaagtccctggacaacgaccggccctacccctagaaccaaatcctcgtcggggcctccgaggcctcgaggacgaggctgtacttatttctgttgcttacatagtcgacggaacggggacccaagtccgtacgttggggtcggttcgggacgggagggtaccgtaggtcgccgtcgtaggttccacgcccgtaaggccttcgccccgttacggtcctactccgttccgtccccgttccctccgttcgtccg

SEQ ID NO: 435515 - DNA, 549 bp, Homo sapiens
  misc_feature: GZ8MTXP01C1KNK.45.38.D05.1.454.CMB.2.raw
  modified_base (227)..(227): a, c, t, g, unknown or other
  modified_base (272)..(272): a, c, t, g, unknown or other
  modified_base (292)..(292): a, c, t, g, unknown or other
  modified_base (322)..(322): a, c, t, g, unknown or other
  modified_base (344)..(344): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccanagtgatgttgggattttagttgtctctggtaccaacacacccggnaacgccccaaatatcattanaggacactaagcggcctgggggttcagtcnctctctgctcagtcctggcacncgcctccctgcatctcgtgggctccgaggctcgaggacgaggctgtatttatttctgttgcttcatatgacgagggaccagctacgttgggtgttcgggcggacgggtacctagggttcgaccgtcgtacggttcgacgcccgtaaggccttccggccccttcggtctaccgtcgttccgttccccgttccctcccgttcgtccg

SEQ ID NO: 435516 - DNA, 586 bp, Homo sapiens
  misc_feature: GZ8MTXP01EAA5Q.45.38.D05.1.454.CMB.2.raw
  modified_base (227)..(227): a, c, t, g, unknown or other
  modified_base (302)..(302): a, c, t, g, unknown or other
  modified_base (369)..(369): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatggcctgcactggaaccanagtgattgttgggtattttagtttgtctctggtaccaacaacaccccggcgaacgacccccaaataatcatttanaggacacgtaagcggtcccgtcgggggtttcaagtcgcttctctcggctccaagtccctggacaacnccggccctaccctagaactaatcctcgtcgggcctccagggctcgaggacgaggctgatttatttctgttgctcaatatgcggaggggaccagctacgttgggtgttcggcgggaggtaccgtaggttcgaccgtcgtaggcacgccccgaaggtcccttccgccccgttcggtcctactccgttccggtccccttcccttcccgttccgtaaccgg

SEQ ID NO: 435517 - DNA, 531 bp, Homo sapiens
  misc_feature: GZ8MTXP01BU8CC.45.38.D05.1.454.CMB.2.raw
  modified_base (228)..(228): a, c, t, g, unknown or other
  modified_base (296)..(296): a, c, t, g, unknown or other
  modified_base (509)..(509): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccanagtgatgttgggattttagtttgtctctggtaccaacaacacccggcaagccccaaataatcatttanaggacactaagcggccctgggggtttcagtcgcttctctgctccaagtcctggcaacacggccctccctgaacaatctctgggcctcaggctcgaggacgaggctgattattactgctgctcatactgggctagggtagtagttactttgggtgttcggcggaggaccaagcgtgaaccgtcttaggtcagcccaaggcttcgcccctggtcnctctgttccccaacccttctcc

SEQ ID NO: 435518 - DNA, 571 bp, Homo sapiens
  misc_feature: GZ8MTXP01A9H10.45.38.D05.1.454.CMB.2.raw
  modified_base (227)..(227): a, c, t, g, unknown or other
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttgggattttagtttgtctctggtaccaacaacaccccggcgaacgacccccaaaactaatcaatttaataggacactaagcggccctcgggggtttcaagtcgcttctctggctccaagtccctggcaacacggccctccctgaacaaatcctctcggggcctccagggctcgaggacgaggctgactttattactgctgctcatatggcaggttagtagttacgtttggtgtttcggacgggtagggtacccaaaggctggaaccgtcccgttaggtcacgccaagggccttcgccccttcggtcctaacgttctcgttcccgtcccgttctccg

SEQ ID NO: 435519 - DNA, 652 bp, Homo sapiens
  misc_feature: GZ8MTXP01A5E7V.45.38.D05.1.454.CMB.2.raw
  modified_base (227)..(227): a, c, t, g, unknown or other
  modified_base (296)..(296): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactgaaccangtgattgttgggtattttagtttgtctctggtaccaacacaccccggcaacgaccccaaatatcattanaggacactagcgccgtgggggttcagtcgcttctctggctcaagtcctggcaacgacggccctaccctgaacaatctcgtcgggctccgagctcgaggacgaggctgatttactttcgtgttcgcttcatagtgcggaggggtaccagcgtacgtttggggtcgttcggggacgggtacgggtacccgtaggggtttaccgacccggttaaccggttaacgggttcccgtaacgggaccccgtaaacggggtccccgttacccgggttcccccccgtttacggggttcccctacccgtttcccgtttcccgggttacccccccttaccccggtttccccttcccggtttccccggg

SEQ ID NO: 435520 - DNA, 536 bp, Homo sapiens
  misc_feature: GZ8MTXP01BT8VG.45.38.D05.1.454.CMB.2.raw
  modified_base (228)..(228): a, c, t, g, unknown or other
  modified_base (297)..(297): a, c, t, g, unknown or other
  modified_base (512)..(512): a, c, t, g, unknown or other
  modified_base (524)..(524): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccanagtgatgttgggattttagtttgtctcctggtaccaacaacacccggcaagcccccaaatatcatttanaggacactaagcgccctgggggtttcaagtcgcttctctggctccaagtcctggcaacacggcctaccctgcaatctctgggctccagctcaggacgaggctgattatttctgttgctcatatgcgagggaccagcacgttgggtgttcgggcggagggtacccagggttcgaccgtcgtaaggttcacgcccgaaggccttcgccccttggtcncgtctcgtcccncctccttcgtcg

SEQ ID NO: 435521 - DNA, 621 bp, Homo sapiens
  misc_feature: GZ8MTXP01APETI.45.38.D05.1.454.CMB.2.raw
  modified_base (225)..(225): a, c, t, g, unknown or other
  modified_base (291)..(291): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcacatggcctgcactggaaccangtgatgttgggtattttagttgtctctggtaccaacaacacccggcaacgccccaaatatcattanaggacactagcgccgtcgggggttcagtcgcttctctcggctcaagtcctggacaaccgacggtccctccctagaactaactctacgtcgggcctccgaggctacgagggacgaggctaggtatttagtttctgtttcgcttcaattagtcgacggaacggggacccagtccgtacggtttggggtacggttcgggacgggtacgggtaccgtacgggttcggacccggttccgtacgggttccacggaccccgaagggtcccgttcccgcccccgttcgggtaaccctccttccgtcccggttcccccacccgttccttccgttcccgg

SEQ ID NO: 435522 - DNA, 685 bp, Homo sapiens
  misc_feature: GZ8MTXP01C5781.45.38.D05.1.454.CMB.2.raw
  modified_base (227)..(227): a, c, t, g, unknown or other
  modified_base (299)..(299): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcatcaccatggcctgcactggaaccaangtgatgttgggtatttttagtttgtctcctggtaaccaacacacccggcgaacgaccccaaatatcatttanaggacactagcggtccgtgggggtttcagtcgtcttctctcggctccaagtcctggacaaccaccggccctaccccgtagaacctaaactccgtaccgtggggccttacccgagggtccttacgagggacgaggtcttagtattttatttcttgttcgcttacattagtacgcggaacggggtaccaggtccgtaacggtttggggttcggtttaccggggacgggtacggggtacccgtagggggtttccgaacccggttaaccgttacgggttacccgacggttaccccgaaagggtcccgttacccggttccccccgttcgggtcccctaaccgttcccgttccggttacccccccttaccccgtttcccgttcccttcccgg

SEQ ID NO: 435523 - DNA, 712 bp, Homo sapiens
  misc_feature: GZ8MTXP01AOV5H.45.38.D05.1.454.CMB.2.raw
  modified_base (154)..(154): a, c, t, g, unknown or other
  modified_base (229)..(229): a, c, t, g, unknown or other
  modified_base (491)..(491): a, c, t, g, unknown or other
tcagacgcgatcgacacgaccggtgctcgatttagtatctgatagttgagtttgggggtcacaagaggcagcgctctcgggacgtctccaccatggcctgggctctgctgctcctcactctcctcactcaggacacaggatcgtgggccctttngccctgactcagcctgcctccgtgtctgggtctccgtggacagtcgatcaccatcggcctgcactaggaaccaangtgattggttgggtattttagtttgctctggtaccaacaccgacccgcgaacaccccaaatatctatttagacggacacgtaaggccggtcccgttacgggggtttacaacggttcgtacttcgtcgtcggtactccgaagttctagggaccaaaccgcccggtacccttcccgtaagacctaaacttccgtcgtcggggcctaccgaagggtcctacgaacgggaccgagggtccttaggtaactttatttcgtggtttcnctatagttacgcggacggaacgggtaccacggtaccgttaggttcggggttacggttaccggggacgggtaaccgggtacgtacgggttccggtaacccggttacggttacgggtacccgaaccggtacccggaacggttcccgttccccggttacccccggttcggtaccccttaaccgtttcccgtaccccggttaccccctaaccccgttccgtcccg

SEQ ID NO: 435524 - DNA, 556 bp, Homo sapiens
  misc_feature: GZ8MTXP01EFKOS.45.38.D05.1.454.CMB.2.raw
  modified_base (227)..(227): a, c, t, g, unknown or other
  modified_base (276)..(276): a, c, t, g, unknown or other
  modified_base (292)..(292): a, c, t, g, unknown or other
  modified_base (319)..(319): a, c, t, g, unknown or other
  modified_base (324)..(324): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatggcctgcactggaaccanagtgattgttgggtatttttagttgtctctgtacaacacacccgcaacnccccaaatatcattanaggacactagcgcctggggttcagtcnctctntgctcaagtcctggcaacgcggccctaccctagaaccatcctcgtcgggcctccgagctacgaggacgaggctagtatttatttctgttgctcatatgcggaggaccagtcctaggttgggtcgttcgggacggtacggtaccgtagggttcgaccgtccgtaggcgacgccgaaggtcttccgccccgttcggtcctacttcctccgttccccttaccctcccttcgtccg

SEQ ID NO: 435525 - DNA, 594 bp, Homo sapiens
  misc_feature: GZ8MTXP01B5H4V.45.38.D05.1.454.CMB.2.raw
  modified_base (296)..(296): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtattttagtttgtctctggtaccaacacacccggcaacgccccaaatatcattanaggacactaagcggtccctgggggtttcagtcgcttctctggctccaagtcctggcaacgaccggcctaccctgaacaatcctctcgggcctccgaggcctcgaggacgaggctgtattatttctgttgctcatatgcgtaggttagttaggttacgtttgggtggtttcgggacgggtacggggacctaaggtcgtcggtacccgtccgtacggttcgacgcccgaaacggtccgttccgcccccgttcggtcctaccgttccgttccgttccccttaccccttcccttccgtcccg

SEQ ID NO: 435526 - DNA, 580 bp, Homo sapiens
  misc_feature: GZ8MTXP01C99F7.45.38.D05.1.454.CMB.2.raw
  modified_base (230)..(230): a, c, t, g, unknown or other
  modified_base (279)..(279): a, c, t, g, unknown or other
  modified_base (300)..(300): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgattggttgggtatttttagttgtctctggtaccaacacacccggnaacgccccaaatatcatttanaggacactaagcggtccctgggggtttcaagtcgtctctctggctccaagtccctggacaacgaccggcccttaccccgtgaaccaatcctcgtcggggacctccgagggctcgagggacgaggctgtatttatttctgttgctcatatgcgacgggccagctacgttgggtgttcgggcggacggtccgtaggtcgaaccgtcgtaggttcacgccgaacggtccttacgcccccttgggtccacgttccgttccgtccccttaccttcccttcgtccg

SEQ ID NO: 435527 - DNA, 553 bp, Homo sapiens
  misc_feature: GZ8MTXP01AI4CF.45.38.D05.1.454.CMB.2.raw
  modified_base (229)..(229): a, c, t, g, unknown or other
  modified_base (298)..(298): a, c, t, g, unknown or other
  modified_base (527)..(527): a, c, t, g, unknown or other
  modified_base (548)..(548): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaangtgatgttgggtattttagtttgtctctggtaccaacaaccacccggcaacgccccaaataatcattanaggacactaagcgccgtcggggttcagtcgcttctctggctcaagtcctggacaacgaccggccctaccctagaaccaatcctcgtcgggcctccgaggctcgaggacgaggctgtatttattctgttgcttcatatgcgagggaccagctacgttgggtgttcgggcggacggtacctaaggttcgaccgtcgtaggttcacgcccgaggccttcgccccttggtccnctccgtcgtccccaccctccncgtcg

SEQ ID NO: 435528 - DNA, 552 bp, Homo sapiens
  misc_feature: GZ8MTXP01CUSE2.45.38.D05.1.454.CMB.2.raw
  modified_base (229)..(229): a, c, t, g, unknown or other
  modified_base (299)..(299): a, c, t, g, unknown or other
  modified_base (345)..(345): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatggcctgcactggaaccaanagtgatgttgggtattttagttgtctctggtaccaacaacacccggcgaacgaccccaaataatcattanaggacactaagcggcctgggggttcagtcgctctctgctcagtccnggacacacgcctaccctgaacaatctcgtcgggctccgaggcctacgaggacgaggctgtatttatttctgttgctacatatgacgtaggttagttagtacgtttggtgtcggcggacggacaagcgtacgccgtcgtaggttcgacgccgaacgtccttaccgccccttcggtccaccttctcgtccccacccttccgttcgtccg

SEQ ID NO: 435529 - DNA, 570 bp, Homo sapiens
  misc_feature: GZ8MTXP01AUCJ6.45.38.D05.1.454.CMB.2.raw
  modified_base (228)..(228): a, c, t, g, unknown or other
  modified_base (287)..(287): a, c, t, g, unknown or other
  modified_base (293)..(293): a, c, t, g, unknown or other
  modified_base (419)..(419): a, c, t, g, unknown or other
  modified_base (443)..(443): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccangtgatggttgggtattttagttgtctctgtaccaacacacccgcgaacaccccaaatancattanaggacacgtaagcgcccgtgggggttcagtcgcttctctggctcaagtcctaggcaacgaccggccctaccctgaacaactctcgtcgggctccgagggcctcgaggacgaggctgtatttatttntgtgctcatagtgacgagggaccngctagtggtgtcgggacggacggtaccgtggttcgccgtcgtaggttccacgttcccgaaggtcccttccggcccccttacggtcccacgttcccgtccgttccccgccccttccgttccgtaaccg

SEQ ID NO: 435530 - DNA, 577 bp, Homo sapiens
  misc_feature: GZ8MTXP01DB0FL.45.38.D05.1.454.CMB.2.raw
  modified_base (230)..(230): a, c, t, g, unknown or other
  modified_base (296)..(296): a, c, t, g, unknown or other
  modified_base (550)..(550): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatcggcctgcactggaaccaangtgatgttgggtattttagttgtctctgtaccaacacacccggcaacgaccccaaatatcatttanaggacactaagccggtccgtcgggggttacagtcgtcttctctcggctcaagtcctaggacaacgaccgccctacccctgaacctaatctcgtagggcctcgaggctcgaggacgaggctgtattatttctgttgcttcatatcgcggtacgggaccagactacggttgggtcgttcgggacgggacggtaccgtaggttcggaccgtcgtaggttcacggcccgaaggtccttaccgccccgttcggtaaccnctctccgtcccttacctccttcgtccg

SEQ ID NO: 435531 - DNA, 529 bp, Homo sapiens
  misc_feature: GZ8MTXP01CICE8.45.38.D05.1.454.CMB.2.raw
  modified_base (227)..(227): a, c, t, g, unknown or other
  modified_base (292)..(292): a, c, t, g, unknown or other
  modified_base (348)..(348): a, c, t, g, unknown or other
  modified_base (504)..(504): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccanagtgatgttgggattttagttgtctctggtaccaacaacacccgcaacgccccaaatatcattanaggacactaagcggcctgggggtttcagtcgcttctctgctcaagtcctggcaacncggccctaccctgcaaatctctgggctccgaggctcaggacgaggctgatttattctgttgctcatatgcgagggaccagcagttgggtgttcgggcggagggtccgtaggttcgcccgtcgtaggttcagccgaaggtcttcgccccttcggtcncgtctcgtcccacctccttcgtccg

SEQ ID NO: 435532 - DNA, 570 bp, Homo sapiens
  misc_feature: GZ8MTXP01A1ZO4.45.38.D05.1.454.CMB.2.raw
  modified_base (226)..(226): a, c, t, g, unknown or other
  modified_base (277)..(277): a, c, t, g, unknown or other
  modified_base (300)..(300): a, c, t, g, unknown or other
  modified_base (539)..(539): a, c, t, g, unknown or other
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccanagtgatgttgggtatttttagtttgtctcctggtaccaacaacaccccggngaacgcccccaaatatcatttanaggacactaagcgcctggggttcagtcgctctctggctcagtcctggacaacgccggcctccctgaacatctctgggctcgaggctcgaggacgagctgatttattcgttagtgcttcatagtcgacgacggggaccagtcgtacgttggggtcggttcggggacgggaggggtacccgtaggttcgacccggtcgtaacggttcgacgcccgaaggccttccgccccgttacggtccnctccgtccgtcccacccttccgttccgtccg

SEQ ID NO: 435533 - DNA, 631 bp, Homo sapiens
  misc_feature: GZ8MTXP01AU0CF.45.38.D05.1.454.CMB.2.raw
  modified_base (225)..(225): a, c, t, g, unknown or other
  modified_base (305)..(305): a, c, t, g, unknown or other
  modified_base (612)..(612): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcacatggcctgcactggaaccangtgattggttgggtatttttagtttgtctctaggtaccaacaaccgaccccggacgaacgaccccaaatatctaatttanaggacacgtaacggccggtcccgttcgggggttacagtcgtcttcgtctggcctcaagttccaggacaaaccgccggtccctaccctagaaccaactcctcgtcgggcctccgaggcctcgaggacgagcttagtatttagtttcgtgttgcttactatagtcggcggtaacggggaccagtccgtacggttgggtcggttcgggacgggtacgggaccgtagggtccgaccggtcgtacggttcaccgcccgaacggtcccgttccgcccccgttggtccctaccgttcccgtcccggttcccccncccttccgttaaccgtccg

SEQ ID NO: 435534 - DNA, 678 bp, Homo sapiens
  misc_feature: GZ8MTXP01BB6CI.45.38.D05.1.454.CMB.2.raw
  modified_base (230)..(230): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaatttggggctgggtccgcagcccccagggaagggctggagtggattgggactgtctactctagtgggaccacctattacagcccgtcctcaagacctcgactggtgatctacaataaacacgtaccaaagaaccaattctaccctgagctgaactctgtcgaccgcgcggacacggaccaaagtattacgtgtgacaaagtagacgggtcctagggaaattacgttcccgttttagaaccccgtaacggttccggggggtaccccgttacgggggtaaaccccccgtttggggttaccccgtaaacccggggtttccccttcccgttaccccgaaacccgggttcccccgttaacccccgaaaccccgggaaaacccgggggttcccccctaaacgggtttcccccggggttttaaccccccccgg

SEQ ID NO: 435535 - DNA, 544 bp, Homo sapiens
  misc_feature: GZ8MTXP01AJS6B.45.38.D05.1.454.CMB.2.raw
  modified_base (225)..(225): a, c, t, g, unknown or other
  modified_base (294)..(294): a, c, t, g, unknown or other
  modified_base (419)..(419): a, c, t, g, unknown or other
  modified_base (422)..(422): a, c, t, g, unknown or other
tcagacgcgatcgacacgaccggtgctcgatttagtatctgatagttggttttgggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatggcctgcactggaaccaanagtgatgttgggattataacttgtctctgtacaacagcaccagacaaacgccccaaactcatgatttangaggcagtagcggccctgagggtttctaatcgtcttcctctggctcaagtctggcaacgacgcctcctgacaatctcgtggctcgagctaggacggacgaggtctagtattattacgtgtcgtcnctnatagtgagtaggttagtagttacgtttgggtgttcggggcggaggacctaagcgtacggtccgttaccgttggttccgaaggacccgtaagggccttaccgcccccgtcggttcctaacccg

SEQ ID NO: 435536 - DNA, 546 bp, Homo sapiens
  misc_feature: GZ8MTXP01BXBXX.45.38.D05.1.454.CMB.2.raw
  modified_base (230)..(230): a, c, t, g, unknown or other
  modified_base (263)..(263): a, c, t, g, unknown or other
  modified_base (294)..(294): a, c, t, g, unknown or other
  modified_base (539)..(539): a, c, t, g, unknown or other
tcagacgcgatcgacacgaccggtgctcgatttagtatctgatagttgggtttggggggggtcacaagaggcagcgctctcgggacgtctccaccatggcctgggctctgctgctccccactctcctcactcaggacacaggatcgtgggcccttttctgccctgactcagcctgcctccgtgtctgggtctcctggacagtcgatcaccatggcctgcactggaaccangtgatgttagggattatactgtctctgtacacngcaccagcaaacgccccaaatcatgatttangaggcagtagcgccctgtagggtttcaagtcgtcttctccgtggctccgtaagtctacgggacaaccgtcccgggcccttccctagaactaacgtctcgtcgggtctccgaggcgtggacggtacggaggtctagtattactactgtctggctgatagtgacgtaggttagtagttcgttggtcggttcgggcggaaggacagtcttgtacgtcttggttcacgcccagctccgcccgttgtccncgttccg

SEQ ID NO: 435537 - DNA, 666 bp, Homo sapiens
  misc_feature: GZ8MTXP01EYFWM.45.38.D05.1.454.CMB.2.raw
  modified_base (158)..(158): a, c, t, g, unknown or other
  modified_base (254)..(254): a, c, t, g, unknown or other
  modified_base (308)..(308): a, c, t, g, unknown or other
  modified_base (341)..(341): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttcngccctgactcagcctgcctcctgtctggtctcctggacagtcgatcaccatcccctgcactggactccgagcggtagtacgttactagtttttaanatgtctcctggtactcagcaacaccgagacaaacgccccaaatcatctatttangtatgtacaagtacgtcgtcctgtacgggttcncgactccgtcttctcgtcgacctacgaagtcgtacggactaacgtccggccctccgtagaccctactcgtcgtcggactccgagtaccgtagaacgtacggtagtcgtagtaacttacgttacggtcgtactaacggtacctaagtagttacgttaacgtttacggttaccgtttacccgtaacgttcggggtaacgttccggggtaacggttaacgggtaccgttaaacgggttccgtaaccggttaccgttacgggttaccgaacccggtacccgtaacggtcccgttaccggttcccccgttaaggttcccgttaaccccgg

SEQ ID NO: 435538 - DNA, 621 bp, Homo sapiens
  misc_feature: GZ8MTXP01DT8KU.45.38.D05.1.454.CMB.2.raw
  modified_base (231)..(231): a, c, t, g, unknown or other
  modified_base (455)..(455): a, c, t, g, unknown or other
  modified_base (472)..(472): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcacttgcagtgtctctggtnactccatcagtagtagtcataaagtttggggctgggtccgccagcccccgagggaagggctggagtggagttgggactgtctactctagtgggacctactattacacgcccgtcctcaacgacctcgactggtgactactacaagtaaacacgtaccaaagaaccctaattcctccctgaacggtctagaactcgtgtcgaccgccgcggacacggaccaaatnttacgtgtagcaaaggngacgggcctagggtaaatttactccgtttgacccgtacggttcgggggcccttacgggggaaaccccttgggtacctacccggttccttcccgttaccaacggcccctaacccgaaccgaacgggcccctaacgttcccgggttccccc

SEQ ID NO: 435539 - DNA, 633 bp, Homo sapiens
  misc_feature: GZ8MTXP01D30DO.45.38.D05.1.454.CMB.2.raw
  modified_base (228)..(228): a, c, t, g, unknown or other
  modified_base (273)..(273): a, c, t, g, unknown or other
  modified_base (292)..(292): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccanagtgatggttgggtattttagttgtctctgtaccaacacacccgnaacaccccaatatcattanaggacatagccgccgtgggggttcaagtcgcttctctggctcaagtcctggacaacgccggccctaccctgaactatcctcgtgggcctccgaggcctacgaggacgaggctgtatttatttcgtgttcgcttacattagtcggacgaacggggtaccaggtccgtaggtttcggggttcggttaccggggacggggtacgggtaacccgtaggggttaccgacccggttcgttaacgggttccgaaccggttacccgaaacgggtcccttcccgggttcccccttcgggtccctaccgttccgttcccgttccccggttccccttcccgttcgttcccgg

SEQ ID NO: 435540 - DNA, 595 bp, Homo sapiens
  misc_feature: GZ8MTXP01DINC2.45.38.D05.1.454.CMB.2.raw
  modified_base (232)..(232): a, c, t, g, unknown or other
  modified_base (348)..(348): a, c, t, g, unknown or other
  modified_base (535)..(535): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcactttgcagtgtctctggtnactccatcagtagtagtcataaagtttggggctgggtccgccacgcccccgagggaaggggctggagtggattgggactgtctactctagtcgggacacctattacagcccgtccncaacgacctcgactggtgatctacaataaacacgtaccaaagaaccaattctccctagagctagaactctgtagacccgcgacggactacggacctaaaatacttacgtgtgacaaggagagggcctgggtaaattcgtcctttgacctaacgtgggggtccttagggggtaaccccttgggtaccncccgttacgccttcaacgccctccaaccgaacggggcccctaacgttcccggttcccccg

SEQ ID NO: 435541 - DNA, 635 bp, Homo sapiens
  misc_feature: GZ8MTXP01B5WQZ.45.38.D05.1.454.CMB.2.raw
  modified_base (227)..(227): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatgcctgcactggaaccaangtgattggttgggtatttttagttgtctccgtaggtaaccaacaaccgaccccggacgaaaccgaccccctaaaataatactaagtttaagaacgggaacaacgtaaggccggtaccccgttacgggggtttacaagtccgtctttctcgtggcctcgaagtcctggacacgccgcctaccctagaactatctacgtcgggcctcgagctcgacggacgagcttagtatttatttctgtcgctactatatcgacggacggacctagcgtacggttgggtacggttcggacgggcggtacgtacggtcgtaccgtccgtaggttccgacgcccgaagtccgttaccggttccccgttacggtcctaccttccgttcccgttaccccttcccgttcccgttccgtaaccg

SEQ ID NO: 435542 - DNA, 599 bp, Homo sapiens
  misc_feature: GZ8MTXP01DDJ8T.45.38.D05.1.454.CMB.2.raw
  modified_base (345)..(345): a, c, t, g, unknown or other
  modified_base (441)..(441): a, c, t, g, unknown or other
tcagacgcgatcgacacgaccggtgctcgatttagtatctgatagttgggtttggggacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccacgccccgagggaagggctggagtggattgggactgtctactcgtagtggaccactattacacgcccgtcctacaagactcgactggtnatctacaaactaaacacgtaccaaagaaccctaaaattcctccctagacggactagaactctgtcgacccgcgacgacacggaccaaaatattacngtagacaaagagacgggtcctagggggtaaactttacttcctttagaaccctagtcgggggcctacggggaaccctggtaccaccgtctccgtcacgcccttaccgacgaacgggcccagttccggtcctccccgtgcccacccttcctcgaacgccg

SEQ ID NO: 435543 - DNA, 664 bp, Homo sapiens
  misc_feature: GZ8MTXP01C3Q1S.45.38.D05.1.454.CMB.2.raw
  modified_base (229)..(229): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttgggtattttagtttgtctctggtaaccaacaaccgaccccggacgaacgacccccaaaatactctaatttagaaggacactaagccggtcccgttacgggggttcaagtcgtcttcgtctcggctcaagtccctggacaacgccggccctaccctagaaccaactccgtacgtgggcctaccgagctcgaggacgaggtctagtattatttcgtgttgcttacattagtcgacggtaacggggacctaggtaccgtacggtttcggggtacggttcggggacgggaacggggtaccgtaggggttcgtacccggttaaccgtacgggttcctaacggcccgtaaacgggtcccgttaccggttcccccgttcgggtcctacccgttcgttcccgttccccgttcccttcccgttccgttaacccgg

SEQ ID NO: 435544 - DNA, 567 bp, Homo sapiens
  misc_feature: GZ8MTXP01B3JY0.45.38.D05.1.454.CMB.2.raw
  modified_base (228)..(228): a, c, t, g, unknown or other
  modified_base (281)..(281): a, c, t, g, unknown or other
  modified_base (297)..(297): a, c, t, g, unknown or other
  modified_base (331)..(331): a, c, t, g, unknown or other
  modified_base (360)..(360): a, c, t, g, unknown or other
  modified_base (410)..(410): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatggcctgcactggaaccaanagtgatgttgggtatttttagtttgtctcgtgtaccaacacgacccgcgaacnccccaaatatcattanaggacactaagcgccgtggggttcagtcgcttcnctgctcagtcctaggcaacgcgcctcccngaacatctctcggctcgagctcgagacgaggctgatttattctgttgctntatatgcgacggaccagcttacggttgggtgttcggcggggtacggtaccgtaggttcgaccgttccgtaaggttcgacgcccgaaacggtccgttccgttcccccgttcggtcctaccgttccttccggttccccttacccttcccgttcgttccg

SEQ ID NO: 435545 - DNA, 683 bp, Homo sapiens
  misc_feature: GZ8MTXP01AVRJQ.45.38.D05.1.454.CMB.2.raw
  modified_base (213)..(213): a, c, t, g, unknown or other
  modified_base (232)..(232): a, c, t, g, unknown or other
  modified_base (272)..(272): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtcccctnacttgcagtgtctctggtnactccatcagtatagtcattaaagtttggggctgggtccncacgccccgagggagggctggagtggattgggactgtctactcgtagtcgggacctactattaccacgccccgtcctacaagaccctcggactggtgatactacaataaacacgtaccaaacgaacctaacttcctccctagacgtctagtaactctggtacgacccgccgacggaacacggacaaattattaacggtgtagacgaaaggtacggagggtaccttagggtaaactttcgttcccgtttaggaaccccgtacggtccggggggtacccttacgggggtaaaccccttcgggttacccgtaaccccgggttccttccccgttaccgaacccggtaccccgttaaccccgaaacccggaaaccgggggccccctaaacgtttccccgggggtttaacccccccg

SEQ ID NO: 435546 - DNA, 622 bp, Homo sapiens
  misc_feature: GZ8MTXP01CCPWD.45.38.D05.1.454.CMB.2.raw
  modified_base (226)..(226): a, c, t, g, unknown or other
  modified_base (254)..(254): a, c, t, g, unknown or other
  modified_base (271)..(271): a, c, t, g, unknown or other
  modified_base (275)..(275): a, c, t, g, unknown or other
  modified_base (292)..(292): a, c, t, g, unknown or other
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccangtgatggttgggtattttagttgtctcngtaccaacaccacccgnaacnccccaaatatctattanaggacactaagcggtcccgtgggggtttcagtcgtcttctctgctcagtccctggacaacgccggccctaccctagaactatcctcgtgggcctccgaggtcctcgaggacgaggctgtatttagtttcgttgttcgcttctatagtgacggacgggacctacgacgtacggttggggttcggttcgggacgggtacgggtaccgtagggttccgtacccggttcgtacggttacgaccggcccgtaacgggtccttacccggttcccccgttccggtcctacccgttccgttcccgttcccccttacccttccccgttccgttaacccg

SEQ ID NO: 435547 - DNA, 574 bp, Homo sapiens
  misc_feature: GZ8MTXP01B2QZE.45.38.D05.1.454.CMB.2.raw
  modified_base (229)..(229): a, c, t, g, unknown or other
  modified_base (298)..(298): a, c, t, g, unknown or other
  modified_base (543)..(543): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaangtgattgttgggtatttttgttgtctctgtaccaacaaccacccggacaacgaccccaaatatcattanaggacactagcggccgtcggggttcagtcgcttctctggctcagtcctcggacaaccgccggccctaccctagaaccatcctcgtcgggcctcgacggctcgaggacgagctagtatttatttctgttcgcttacatagtgacggacggacacgtcgtacgttgggtgtcgggtacggacgggtaccgtaggtcgtaccgtccgtaggttccgacgcccgacggtcttcccgccccttcggtccncctcgttcccgtcccgccctccgttcgtccg

SEQ ID NO: 435548 - DNA, 727 bp, Homo sapiens
  misc_feature: GZ8MTXP01B8NO2.45.38.D05.1.454.CMB.2.raw
  modified_base (223)..(223): a, c, t, g, unknown or other
  modified_base (289)..(289): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcatcacatgctgcacgtgaaccanagtgagttgttgggtatttttgttgtctcgtgtaccaacacacccgcaacacccaatatctattanaggacacgtagccggtccgttggggttacagtcgtcttcgtcgtcggctacgtaagtcccgtacggaccaaaccgcccggtccctaccccgtagaacctaacgttccgtacggtcggggccctaccggacgggtcctacggacggacggtaggtcttaggttatttacgtttcgtgttcgacttactaagttacgtcggtacggacggggtaactacggtaccgttacgggtttcggggtcgggttaccggggaccgggggtacggttacccgggttacgggttacccggtaacccggttaaccggttaacggttacccgaaccggttaccccggtaaacgggtccccgttccccggttccccccgttccgggttaaccctccccgtttcccggttcccccgttcccccggttcccccttcccgttcccgttcccggg

SEQ ID NO: 435549 - DNA, 569 bp, Homo sapiens
  misc_feature: GZ8MTXP01BNHEF.45.38.D05.1.454.CMB.2.raw
  modified_base (345)..(345): a, c, t, g, unknown or other
  modified_base (430)..(430): a, c, t, g, unknown or other
  modified_base (448)..(448): a, c, t, g, unknown or other
  modified_base (492)..(492): a, c, t, g, unknown or other
  modified_base (539)..(539): a, c, t, g, unknown or other
tcagacgcgatcgacacgaccggtgctcgatttagtatctgatagttgggtttggggacggacctcctgtgcaggaaaatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctgggtccgccacgccccgagggaaggggctggagtggattgggactgtctactctagtcgggaccactattacagccccgtcctacagactcgactggtnatctacaataaacccacgtacaaagaaccattacctccctgagctagaactctgtcgaccgcgcgacacggacaaatatactgtncaagagaggctggaattntctttgaccgtacgtgggcctgggaaccctggtcaccgtctccnctacgccctccaccgaacgggcccagttcccgggttccttcccccgnggccctcccctccgttacccaacgcgtccc

SEQ ID NO: 435550 - DNA, 571 bp, Homo sapiens
  misc_feature: GZ8MTXP01CKYAK.45.38.D05.1.454.CMB.2.raw
  modified_base (227)..(227): a, c, t, g, unknown or other
  modified_base (281)..(281): a, c, t, g, unknown or other
  modified_base (303)..(303): a, c, t, g, unknown or other
  modified_base (341)..(341): a, c, t, g, unknown or other
  modified_base (384)..(384): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcatcaccatggcctgcactggaaccanagtgatggttgggtagtttttagtttgtctcctggtaaccaacaacaccccggnaacgcccccaaatatcatttanaggacactaagcggcccgtgggggtttcagtcgcttcnctggctcaagtcctggcaacgccgcctaccctgaacaatcctntcgggctccgagctcgagacgaggctgtatttattctgttgctctatatgacgagggaccagcgtacgttgggtgttcgggacgggtagggaccgtggttcgccgtcgtacggttcacggcccgaacggtccgttccgccccgttcggtcctaccttcctccgttccccacccgtcccttcgttccg

SEQ ID NO: 435551 - DNA, 643 bp, Homo sapiens
  misc_feature: GZ8MTXP01BVLKN.45.38.D05.1.454.CMB.2.raw
  modified_base (229)..(229): a, c, t, g, unknown or other
  modified_base (296)..(296): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggcccctttctgccctgactcagcctgcctcgtgtctgggtctcctggacagtcgatcaccatggcctgcactggaaccangtgatgttgggtatttttagttgtctctgtaccaacacgacccgcgaacgaccccaatatctattanaggacactaagcggccgttcgggggtttacagtcgtcttctctggcctccgaagtccgtcggacaaccgaccggccctaccctgaacctaatccgtcgtcgggcctccgaggctcgaggacgaggctgtatttatttctgttgcttcattagtcggacggtacggggacctagcgttacggttggggtcggttcgggacgggtacgggtacccgtagggttccgacccgggttaaccgtaacgggttcctacggcccgtaaacgggtcccttcccggttcccccgttcgggtccctacccgttccgtttccccggttcccccttaccccgtttcccgttccgtcccg

SEQ ID NO: 435552 - DNA, 560 bp, Homo sapiens
  misc_feature: GZ8MTXP01BJ1HG.45.38.D05.1.454.CMB.2.raw
  modified_base (227)..(227): a, c, t, g, unknown or other
tcagacgcgatcgacacgaccggtgctcgatttagtatctgatagttgagtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttgggtatttagtttgtctctggtaccaacaacacccggcaacgccccaaactaatcattataggacactaagcggccgtcgggggtttcaagtcgcttctctggctccaagtctggcaacacgcctccctgacatctctgggctcgagctcgaggacgaggctgtatttatttctgttgctcaattagtgcagggaccagtcacgttggggtgttcgggcggtagggacctaggttcgaaccgtcgttagggtccacgcccgaaggttccgttcgcccccgtcggtcctaaccgttcctcgtttacccccctcccgttccgtccg

SEQ ID NO: 435553 - DNA, 658 bp, Homo sapiens
  misc_feature: GZ8MTXP01ADH0N.45.38.D05.1.454.CMB.2.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagcccttcggagaccctgtcccctcacttgcagtgtctctggtgactccatcagtagtagtcataaatttggggctgggtcgccagcccccgagggaagggctggagtggattgggactgtctactcgtagtgggaccacctattacagcccgtccctcaagacctcgactggtgatactacaactaaacaccgtaccaaagaaccctaaattcctacccagtaggccttagaactctgtcgaccgcgcggacacggaccaaatacttacgtgtgcaaggaggaacggccttaggggtaaactttcgtacccgttttagacccgtaacgtcggggggtccccttgggggtaaacccccttggggttaccctaacccgggttcccttccccggtttacccaacgggtaccccttaaccccgaaccccggtaaacgggggaccccctaacgttcccgggggtttcccccccg

SEQ ID NO: 435554 - DNA, 577 bp, Homo sapiens
  misc_feature: GZ8MTXP01BLE56.45.38.D05.1.454.CMB.2.raw
  modified_base (306)..(306): a, c, t, g, unknown or other
  modified_base (337)..(337): a, c, t, g, unknown or other
  modified_base (341)..(341): a, c, t, g, unknown or other
  modified_base (354)..(354): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtatttttagtttgtcttcctggtaaccaacaacaccccggcgaacgcccccaaatatcatttanagggacactaagcgccgtggggttcagtcgnttcnctggctcagtccnggcacacgccctccctgcatcctcgtgggctcgaggctcgaggacgaggctgtatttactttcgttgttcgctcatatcgcggacggggaccagccgtacgtttggggtcgttcgggacggagggtaccagcgtcgaaccgtcgttaggtcacggtcccgaacggccgttccggcccccgtggtccctaaccgtccgtccggttaccccctcccgttccgtcg

SEQ ID NO: 435555 - DNA, 713 bp, Homo sapiens
  misc_feature: GZ8MTXP01AVHI4.45.38.D05.1.454.CMB.2.raw
  modified_base (199)..(199): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcgganaccctgtccctcacttgcagtgtctctggtgactccatcagtagtagtcataaagtttgggctggtccgccgacgccccgagggaacggcgtggagtggattgggactgtctactcgtagtcggacctactatacgacgcccgtccctacaacgtcctcgactggtcgactactacaactaaacacgtaccaaacgtaaacctaacttcctacccgtagacggtctacggtaacttcgtcggtacggacccggtcccggaccggaaccaaccgggacctaaagtacgtttaaccgtggtacgacaaagggacggacgggacccttagggaaactttacgttcccgtttacggaaccccgtacggtccgggggtacccgttacggggtaaaccccgttcgggttacccgtacccggttcccgttccccgttcccgaaacccggtcccccttaaccccggaacccggaacccgggggttaccccctaaccggtttccccggggttttccccccccg

SEQ ID NO: 435556 - DNA, 573 bp, Homo sapiens
  misc_feature: GZ8MTXP01DLPGE.45.38.D05.1.454.CMB.2.raw
  modified_base (226)..(226): a, c, t, g, unknown or other
  modified_base (430)..(430): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcacatggcctgcactggaaccanagtgatgttaggattataaccttgtctctgtacaacagcaccagacaaacgacccccaaactcatgatttatgaggcagtaagccggccctgtagggtttcaatcgcttctctgctccaagtctaggccaacgaccgtccctcccgtagacaaactctcgttcgggcctccgaggcctaggaggacgagctgattactagtcgntcgctacatatcgtgaggttagtgttaacgtttggtcggttcgggcgggtaagggcctaaaggttccgttacggtacccgttccgttaacggttccaaccggacccgaacggtcctccgcccccgtcgggttccttaaccccg

SEQ ID NO: 435557 - DNA, 560 bp, Homo sapiens
  misc_feature: GZ8MTXP01EH3CK.45.38.D05.1.454.CMB.2.raw
  modified_base (228)..(228): a, c, t, g, unknown or other
  modified_base (273)..(273): a, c, t, g, unknown or other
  modified_base (277)..(277): a, c, t, g, unknown or other
  modified_base (295)..(295): a, c, t, g, unknown or other
  modified_base (328)..(328): a, c, t, g, unknown or other
  modified_base (527)..(527): a, c, t, g, unknown or other
  modified_base (545)..(545): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatggcctgcactggaaccanagtgatgttgggtattttagttgctctgtaccaacaacaccccgnaacncccccaaatatcatttanaggacactaagcgcctggggttcagtcgcttcnctgctcaagtcctggacaacgcgccctcctagaactaatctcgtcgggcctcgaggctcgaggacgaggctgagtttattctgttcgcttcatatgacgagggaccagctacgttggggtcgttcgggacgggtaggaccgtaggttcgacccgtcgtacggttcacgcccgaaggtccgttccgccccgttcggtccncgttccgttccgtccccnccttccgttcgtccg

SEQ ID NO: 435558 - DNA, 619 bp, Homo sapiens
  misc_feature: GZ8MTXP01A7EY4.45.38.D05.1.454.CMB.2.raw
  modified_base (230)..(230): a, c, t, g, unknown or other
  modified_base (233)..(233): a, c, t, g, unknown or other
  modified_base (353)..(353): a, c, t, g, unknown or other
  modified_base (365)..(365): a, c, t, g, unknown or other
  modified_base (383)..(383): a, c, t, g, unknown or other
  modified_base (445)..(445): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcgatcaccatggcctgcactaggaaccaangtnagttggttgggtagtttttgttgtctctggtaaccaacaccgacccgacaaccgaccccaaatatctaattaagtaggacacgtaagccggtcccgtcgggggtttcaaggtcgtcttcnctgctcagtccnggacaacgccgcctaccngaacatctcgtcgggctccgagctcgaggacgacgctgtatttacgttcttgtagtccttanaatacgtcgacgggacggtaccctagcgtaaccggttgggtcggttcggggacgggtacgggtaccggtaggttaccggtcccggtcgtacgggttcgaaccggaccgtaacgggcccttccggttccccgttcggtcctccgtcgttcccggtcccttcccgtccttcgtccg

SEQ ID NO: 435559 - DNA, 655 bp, Homo sapiens
  misc_feature: GZ8MTXP01EVR21.45.38.D05.1.454.CMB.2.raw
  modified_base (224)..(224): a, c, t, g, unknown or other
  modified_base (300)..(300): a, c, t, g, unknown or other
tcagacgcgatcgacacgaccggtgctcgatttagtatctgatagttgagtttgggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatgcctgcactgaaaccanattgatgttgggtagttttagtttgtctctgtaccaacaacgacccggacgaacgaccccaaactatactatttanaggacacgtaacgcggacccgttcgggggtttacaacgtcgtcttctcgtcggcctccaacgttctaggaccaaccgaccggtaccctccctgaacctaaactccttcgtcgggacctccgacggtctacgaggaccggaggaccttagtaactttatttccgtggttctctactaagtatcgggacgtaacggggaccaggtccgtacggttggggttacgttcggggacggtaggggtaccgtagggttccgaaccggttccgttacgggtccacggacccgtaacgggcccgttcccggttaccccgtcggtacctccgttccgtcccgttccccgtccccgttcccttccg

SEQ ID NO: 435560 - DNA, 810 bp, Homo sapiens
  misc_feature: GZ8MTXP01A4ME2.45.38.D05.1.454.CMB.2.raw
  modified_base (219)..(219): a, c, t, g, unknown or other
tcagacgcgatcgacacgaccggtgctcgatttagtatctgatagttgggtttgggggctcagaagcagagttctggggtgtctccaccatggcctggacccctctctggctcactctcctcactctttgcatagggtctgtactttcttctgggctgactcaggagtctgctgtgtctgtggccttgggacagacagtcaagatcacatgccacgganacagcctcgaggagggcactatgacaaactggacaaccaacagaacggccgggacacggcccctactacttgtactagtagtttaacggaaaaccgcccggccccgtaccgggactccccgacgaccgtattccgtcgtcggcctacccaacccctacgaacggaaaccaccgtaacgtccctttacccttaacggaacccctaacgttacccgaaccggttcgggggtaacccttaccggaaacgggggacccgggtaaaaggtaaggttacgggaacgggtccgttaagggtaaaccctttaagtttaagttcggaccaacgtaccgaacggttacccccggggaaactaaacccgttaaagttaagtttacgggtttaaacgttccggttttacccggacccgggtacccccgggggtaaacctaaaccggggttccctaaaccccgggttccgtttcggggtaacccaccgggtaacccccgaaaccgggtacccccaaacccccgttacgttccggttaccccgtaacccttccgtttaaccccgttaccccctaccccgttccctttccgttaacccgggtcccg

SEQ ID NO: 435561 - DNA, 639 bp, Homo sapiens
  misc_feature: GZ8MTXP01A9JTZ.45.38.D05.1.454.CMB.2.raw
  modified_base (231)..(231): a, c, t, g, unknown or other
  modified_base (301)..(301): a, c, t, g, unknown or other
  modified_base (403)..(403): a, c, t, g, unknown or other
  modified_base (405)..(405): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactaggaaccaangtgattggttgggtattttagtttgtctcctggtaaccaacacacccggcaacgacccaatatctattanaggacactaacgcgtccgtgggttacagtcgcttctctgctactagtcctggacacgccggccctacctgaactactctcgtcggctcgagctcgaggacgngntgtatttattctgtgctcatatcgacgacggtacaggctacggttggggtcggttacgggacgggacggggtaaccgtaggggttaccggtacccggtaaccggttacggacccgtaaccggcccggtaaacggggtcccttcccgggttcccccccgtttacgggtccccggtaacccttccccgttacccggtttacccccgttacccccgtttcccttccggttaacccgg

SEQ ID NO: 435562 - DNA, 590 bp, Homo sapiens
  misc_feature: GZ8MTXP01COSVL.45.38.D05.1.454.CMB.2.raw
  modified_base (230)..(230): a, c, t, g, unknown or other
  modified_base (310)..(310): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttgggtagttttagtttgtctcctggtaccaacaaccaccccggacgaacgacccccaaataatctaatttanaggacactaagcggacccgttcgggggttcaagtcgcttctctggctccaagtcctggacaacgaccggccctacccctagaaccaattcctcgtcgggcctccgaggctacgaggacgaggctagtattatttctgttgcttcatatgcgaacgggtaccagctacgttggggtgttcgggacggagggtacctaggtcgaccgtcgtaggttccacgccgaacggtcttccgccccttcggtcctaccgtctcgtccccacccgttccttcgtaaccg

SEQ ID NO: 435563 - DNA, 578 bp, Homo sapiens
  misc_feature: GZ8MTXP01CQ7KD.45.38.D05.1.454.CMB.2.raw
  modified_base (364)..(364): a, c, t, g, unknown or other
  modified_base (397)..(397): a, c, t, g, unknown or other
  modified_base (443)..(443): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagcccttcggagaccctgtccctcacttgcagtgtctctggtgactccatcagtagtagtcaattaagtttggggctggtccgccacgcccccgagggagggctggagtggattgggactgtctactcgtaggtggaccacctatacacgccccgtcctcaagaccctcgatggtnatctacaataaacacgtaccaagaacctaatcncctagagctagaactctgtacgaccgccgcggacacgacctaaatntacgtgtagcgaagagacggcctaggtaattactcgttcgaccgtacgtcgggccttagggacccttggtccgaccgttccttccgttcaaccgtccctccgaccgacgggccctaacgttcccggtttaacccc

SEQ ID NO: 435564 - DNA, 620 bp, Homo sapiens
  misc_feature: GZ8MTXP01A7HBY.45.38.D05.1.454.CMB.2.raw
  modified_base (228)..(228): a, c, t, g, unknown or other
  modified_base (276)..(276): a, c, t, g, unknown or other
  modified_base (297)..(297): a, c, t, g, unknown or other
  modified_base (334)..(334): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatggcctgcactggaaccanagtgattggttgggtattttagttgtctctggtacaacaacacccggnaacgaccccaaatatcattanaggacactaagccgccgtggggttcagtcgcttctcngctcaagtcctggacaacgacgccctaccctgaactatctcgtgggctcgagctcgaggacgaggctagtatttattctgttcgctctagtagttcgacggtacggggacctagtcgtaacgtttggggtcggttacgggacgggtacgggtaccgtagggtttaccgacccggtcgtacgggttccaaccggacccgttaacgggccttcccggcccccccgttgggtcccctacccttcccgttacccggttccccccaaccccgtttcccgttcccgtcccgg

SEQ ID NO: 435565 - DNA, 703 bp, Homo sapiens
  misc_feature: GZ8MTXP01AYKAD.45.38.D05.1.454.CMB.2.raw
  modified_base (286)..(286): a, c, t, g, unknown or other
tcagacgcgatcgacacgaccggtgctcgatttagtatctgatagttgggtttggggacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtctataaagttttggggctgggtccgccacgccccgaggggaacgggcgtggaggnggagttgggactgtctactcgtaggtcggaccactatacacgcccgtacctcaacgactcgacgtggtgatctacaaactaaacacgtacaaacgaaccctaaaagttccctaacctaggacggtcctacgtaaccttcgtcgtaccgacccggccgacggaaccaccggtaaccaaagttaattacgtgtacgacaaaggaggacggtaccgttaggggtaaactttacgttccgtttaacggaacccgtcggtcggggaccgttacgggggtaaaccccttggggtaccctacccggttcctaacccgttcaccggtcccttacccgaaaccggtaacccgggttccccttacggttccccggttcccttacccccggtcggcccctaccccgttaccctccgaacggtaacccg

SEQ ID NO: 435566 - DNA, 751 bp, Homo sapiens
  misc_feature: GZ8MTXP01AVN0V.45.38.D05.1.454.CMB.2.raw
  modified_base (229)..(229): a, c, t, g, unknown or other
  modified_base (299)..(299): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccangtgatgttgggtattttagtttgtctctggtaccaacaaccgacccggcaacgaccccaaatatcattanaggacactaagccggtcccgtgggggtttcaagtccgtcttcgtctcggtctccgtaagtcccgtacgggacctaaaccgacccgggtccctaacccctagtaacctaaacttccgttaccgttcgggggaccttccccgaagggtccctacgaacgggtaaccggagggtccttaggttaatttttacgtttcgttggtttcgcttacgtaattagtcgggacgaaacgggggtaccaacggtcccgttaaggtttcgggggtggttcggggaccggggtaggaacccgtggggttaccgacccggttaacggttaacgggttccgaaccggttccccggtaaacgggggtccccttcccggggttcccccgttaccggggttccctaccccggttcccgttccccggtaaccccccggttccccttaaccccggttcccgttaacccggg

SEQ ID NO: 435567 - DNA, 712 bp, Homo sapiens
  misc_feature: GZ8MTXP01EPZHE.45.38.D05.1.454.CMB.2.raw
  modified_base (156)..(156): a, c, t, g, unknown or other
  modified_base (226)..(226): a, c, t, g, unknown or other
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggtccctttcngccctgactcagcctgcctcgtgtctggtctccgtggacagtcatcaccatcggcctgcactagaaccangtgattggttgggttatttttagttcgtcttcgtaggtaccaacgaaccgacccggacgaaccacccctaaatactactaattagtacgggactaacgtaacggccgtaccggttacgggggtttacaacgtccgtctttcgtacgtcggtacctacctaacggtcccgtacggaacctaaaccgtcccggtaccccttaacccgtagaacccgttaactcccgtaccgtccgggtacccttaccggaggtacccgtacggaaacgggtaccgtacgggtacttaggttaacttttacgtttcgttgtacgtccttacgtaattacgtacggacggggaacggtaccaggtcgttacgggttggggtcggtacgggacggggtagtaccggtggttaccgcggtaacgtagttccgacgaccgtacggtccttccgttcccgttggtaacctccttccgttcccggtcccttccctcgttccgccg

SEQ ID NO: 435568 - DNA, 645 bp, Homo sapiens
  misc_feature: GZ8MTXP01AWPVH.45.38.D05.1.454.CMB.2.raw
  modified_base (228)..(228): a, c, t, g, unknown or other
  modified_base (343)..(343): a, c, t, g, unknown or other
  modified_base (408)..(408): a, c, t, g, unknown or other
  modified_base (443)..(443): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtggccctttctgccctgactcagcctgcctccgtgtctggtctcctggacagtcgatcaccatggcctgcactggaaccaangtgattggttgggtatttttagttgtctctggtaaccaacacacccggacaacgaccccaaatatctattagaggacacgtaagccggtccgttagggggttcaagtcgtcttcnctgctacagtccctggacaacgaccgtccctaacctagaactaatctcgtcggtctcgaggtccngaggacgtaggctagtatttattcgtgttcacttnagtagtcgacggagggaccagtccgttaggttgggtacgttaccgggacgggtacgggtacccgtaagggttcgaccccggttcgtaacggttccgaacgaccccggtaacggcccttccccggttcccccgttacgggtcccctacccgttcccgtttaccccgggttccccccgttaccccttccgtttccccgtccggg

SEQ ID NO: 435569 - DNA, 605 bp, Homo sapiens
  misc_feature: GZ8MTXP01C95PT.45.38.D05.1.454.CMB.2.raw
  modified_base (228)..(228): a, c, t, g, unknown or other
  modified_base (232)..(232): a, c, t, g, unknown or other
  modified_base (400)..(400): a, c, t, g, unknown or other
  modified_base (424)..(424): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcatcacatggcctgcactggaaccaanagtnatgttgggtattttagtttgtctctgtaccaacaacacccgcaacgaccccaataatcattataggacactaagcggcctcggggttctaatcgtctctctgctcaagtcctggacaacgaccgccctacccctgaacaatctacgtgggcctcgaggctgaggacgnggctgtaattattactgtctgctnaattagtggtagtaaggttagtaggtttacgtttgggtcggttacgggacgggtacggtaacccaaggtccgtcggtaaacccgtcgttaaacgggtccacggtaccccgaaggttcccgttccggcccccgtttcgggtacctccgttccgtccgggttccccctcccgttcccgttccg

SEQ ID NO: 435570 - DNA, 735 bp, Homo sapiens
  misc_feature: GZ8MTXP01AJ262.45.38.D05.1.454.CMB.2.raw
  modified_base (231)..(231): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacngtgagttggttgggtatttttagtttgtctccgtggtaccaacaaccaccccggacgaacgcccccaaatatctatttagacgggacactaacgcggcccgttcgggggtttacagtcgtcttctcgtcggctacaagtcctggcaacgaccggccctaccctgaactatccgttacgtcggggtccttaccgaagggtccctacgacggggtaaccggagggtccgttaggtaacttttacgtttcgttggttcgtacttacctaagttagtcggacggaacggggacctacggtaccgttacgttgggggttcggttccggggaacgggtcgggggtaacccgtaggggttaccgtcccggttaaccgtaacgggttaccgtaccggaacccgtaacgggggtccctttccccggccccccggtttccggggtcccttaccccgttcccgtttcccggttcccccccggttaaccccttccccgttaaccgtttcccccggg

SEQ ID NO: 435571 - DNA, 629 bp, Homo sapiens
  misc_feature: GZ8MTXP01AMLKB.45.38.D05.1.454.CMB.2.raw
  modified_base (299)..(299): a, c, t, g, unknown or other
  modified_base (333)..(333): a, c, t, g, unknown or other
  modified_base (350)..(350): a, c, t, g, unknown or other
  modified_base (367)..(367): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggacagtcatcaccatctctgcactgaaccagcagtgatgttggattataaccttgtctcctggtaccaacagcacccaggacaaacgcccccaaatcatgatttangaggcagtaagcgcctgagggttcatcgcttctntgctcaaagtctgcacncggcctctgacatctcnggctcgagtctaggacggtacgaggctgtaattattacgtggtacgttgtccttactaatcgttaggtacgtaagggttacgttacggtttaacggttttcgggggttacggtttccgggggaaccggggttacggggtaaacccgttaacgggtaccgttaccgggttaccccggttccgtttaaaccgggttccgaacccgggttaaccccgaaaggggtccccgttacccggtcccccccgggttcggtttaacccccg

SEQ ID NO: 435572 - DNA, 739 bp, Homo sapiens
  misc_feature: GZ8MTXP01AESIL.45.38.D05.1.454.CMB.2.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatcggcctgcactggaaccaacagtgagtggtttgggtatttttagtttgtctccgtaggtaacccaacgaaccacccccggacgaaaccgacccccctaaaactaactcctaatttaagtaacgggaacctaacgtaaacggcccgggtccccgttacgggggttttacaacggttccgtactttccgtcgtcggacctaccgaagttcccctaggacaaaccgaccggtccctacccgtacgaactaactccgtacgtcggggtacctaccgacgggtcctacgaacgggacggtacgggtaccttaggtattttacgtttccgtggtttcgcttatagtacgtcggacggaacgggacgtacgtcgtacggttggggtacggttccgggacggggtacggtaccgtacgggtaccgtaccggttcgtacgggttacgaccgacccgtaaggtcccgttcccggttcccccgttcggtcccttacccttccgttccccgtaccccttaccccgttcccgttcgtcccg

SEQ ID NO: 435573 - DNA, 699 bp, Homo sapiens
  misc_feature: GZ8MTXP01CX6XY.45.38.D05.1.454.CMB.2.raw
  modified_base (237)..(237): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagcccttcggagaccccttgtcccctcactttgcagttgtctcgtggtnactccatcagtagtatcattaaagtttgggctgggtccgccacgcccccgaggggaagggctggagtggagtgggactgtctactcgtagtcgggacctaccgtattaccgacgccccgtaccctacaacgaccctcgacgtggtagtatacctacaactaaaccaccgtaaccaaacgtaacctaaacttccctaccctaggacgtacctagaaccttcgtacggtacggaccccgcggaccggacgaccggactaaaactacttacgtggtacgacgaaacggaggacggtccgtaggtaaactttcttaccgttttacgacccgtaacgggtcgggggtcccgttacggggtaaaccccgttggtacccgtacccggttcccgttcccttaccgaacccggtacccctaacccgaacccgtaaccggggcccctaaccggttcccgggtttaacccccg

SEQ ID NO: 435574 - DNA, 613 bp, Homo sapiens
  misc_feature: GZ8MTXP01BUICP.45.38.D05.1.454.CMB.2.raw
  modified_base (223)..(223): a, c, t, g, unknown or other
  modified_base (265)..(265): a, c, t, g, unknown or other
  modified_base (271)..(271): a, c, t, g, unknown or other
  modified_base (292)..(292): a, c, t, g, unknown or other
  modified_base (329)..(329): a, c, t, g, unknown or other
  modified_base (339)..(339): a, c, t, g, unknown or other
  modified_base (345)..(345): a, c, t, g, unknown or other
  modified_base (353)..(353): a, c, t, g, unknown or other
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatggcctgcactgaaccanagtgattgttgggtattttagttgtctctggtaccaacaacncccggnaacgaccccaaatatcattanaggacactaagcgtcccgtgggttacagtcgctctcngctcagtccngacacncgctcccngctatctctgggcctcgaggcctcgaggacgaggtctacggtatttacgttctgttcgcttctaagtcgtcgacggagggacccagtccgtaggttgggtcggttccgggacggggaggtacccgtagggttccgacccggttaacgtaacgggttccgacggttacccggtaacgggtcccttacccggttacccccgttcgggttccctaaccgttccgttcccggttccccgttcccctttccgttaaccgtccggg

SEQ ID NO: 435575 - DNA, 733 bp, Homo sapiens
  misc_feature: GZ8MTXP01ASEMU.45.38.D05.1.454.CMB.2.raw
  modified_base (158)..(158): a, c, t, g, unknown or other
  modified_base (229)..(229): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttcngccctgactcagcctgcctcgtgtctgggtctcctggacagtcgatcacatcggcctgcactaggaaccangtgagttggttgggttatttttagttgtcttccgtaggtaaccaaaccgaccgaccccggacaaaccgaccccctaaaataactacctaagtttagtaacggactaacgtaaggcccggtccccggttacgggggtttacaacggttccgtctttccgtcgttcgggccttaccgtaacggtcccgtacgggacctaacccgtaccgggtccccttaaccccgtagaacctaacttccgtaccggttcggggccttaccgaacgggtcctacgaacgggaccggaggtctaggttacttttacgtttcgttagttcgtacttactagtacgtcggacggtacggggaccaggtcgttagggttcgggtggttaccgggcggggtaacggtaccgtagggttcggaccccggtcgtaacgggttcgacggcccgtaacggtcccttacccggccccgttcgtaactccgtcccttcccgttaccccttcccttccgttccgtccg

SEQ ID NO: 435576 - DNA, 625 bp, Homo sapiens
  misc_feature: GZ8MTXP01ECIQD.45.38.D05.1.454.CMB.2.raw
  modified_base (230)..(230): a, c, t, g, unknown or other
  modified_base (438)..(438): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcgatcaccatggcctgcactaggaaccaangtgatgttgggtattttagttgtctctgtaccaacacacccgcaacgaccccaaatatctattagaggacactaacgcggtccgtggggttacaagtcgtcttctctcggctacaagttcctacggacaacgccggccctacccctagaactaatctacgtgggcctccgaggctacgaggtacaggctagtatttactttctgttcnctacatatcgacggacgggtacagtcgtacggttgggtcggttcgggaacgggtcgggtaccgtacgggttcgacccggttcgttaacggttcgaaccggttacccgtaaacgggtcccgttccggttcccccgttgggtccctccgtttccggttcccgttccccacccttcccgttccgtcccgg

SEQ ID NO: 435577 - DNA, 671 bp, Homo sapiens
  misc_feature: GZ8MTXP01DT5CS.45.38.D05.1.454.CMB.2.raw
  modified_base (159)..(159): a, c, t, g, unknown or other
  modified_base (207)..(207): a, c, t, g, unknown or other
  modified_base (224)..(224): a, c, t, g, unknown or other
  modified_base (449)..(449): a, c, t, g, unknown or other
  modified_base (470)..(470): a, c, t, g, unknown or other
  modified_base (473)..(473): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggtccctttcngccctgactcagcctgcctcgtgtctggtctcctggacagtcatcacntgctgcactagaaccangtgtagttggttagggttatttttagttgtctccgtagtaacccaacaaccgaccccggacaaacgaccccaaatatactaatttagacggactacgtaagccggtaccgttacggggttacacgtcgtcttctcgtcgcctaccgaacgtcccgtacggacctaaacgccggtcccctaacccgtagaactacgtcgtcgtcgggcctcgagtctacgagacgnggctgtatttagttctgttcnctntatagtcggacggcgaaccgtagtacgtcggtttggggtccgttacgggaccgggagggtaccgttacgggttaccgccggttaacgtaacggccgaccggaccgtaaacggtcccgttacccggttccccgttaccggttaaccctaccgtttcccgtttcccgggtcccccttccccgtttccgttccgtcccggg

SEQ ID NO: 435578 - DNA, 641 bp, Homo sapiens
  misc_feature: GZ8MTXP01CW1P3.45.38.D05.1.454.CMB.2.raw
  modified_base (158)..(158): a, c, t, g, unknown or other
  modified_base (229)..(229): a, c, t, g, unknown or other
  modified_base (302)..(302): a, c, t, g, unknown or other
  modified_base (442)..(442): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtgggccctttntgccctgactcagcctgcctccgtgtctgggtctcctggacagtcatcacatggcctgcactggaaccaangtgatggttgggtattttagtttgtctctaggtaccaacacacccggacaacgaccccaaatactctaattanaggacacgtaacgcgtcccgttgggggttcaagtcgtctctctggctcaagtcctggacaacgcggcctaccctagaactaatctacgtcgggactccgaggtctcgaggacgaggctagtattatttcgtgttgcttanatagtcgcggaacggggtacctagtacgttacggtttgggtcgggttacgggacgggtacgggtaccgtaagggttcggtaacccggtcgttaacggccgaacgttaccccgtaaacggtcccgttacccggcccccgttacgggtaaccctaccgtttccgtcccgttacccccgttacccttcccgttccgtccggg

SEQ ID NO: 435579 - DNA, 652 bp, Homo sapiens
  misc_feature: GZ8MTXP01EUIUM.45.38.D05.1.454.CMB.2.raw
  modified_base (231)..(231): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatggcctgcactacggaacccaanagtgagttggttgggtagtttttagtttgtctctgtaaccaacacaccccggcgaaacaccccaaatatctattagaggacacgtaagcggtccgtggggttacagtccgtacttctctcggctacgaagtccgtaggaccaacgacccggtccctacctagaacctaagtctacgtcgggacctcgagtctacgagacgaggtctgtatttttacttcgttaggttctactataactagtcggacgaaggggtaccacggtaccgttacgggtttcgggttacgggttccggggaaggggtaccgggtacgttaacgggttcgtaccggtcgttacgggttaccgacgttaccgacggtccgttcccggttccccttcggtaactccgttctccgttccccgccttccgttcgtaaccgg

SEQ ID NO: 435580 - DNA, 635 bp, Homo sapiens
  misc_feature: GZ8MTXP01DOHIR.45.38.D05.1.454.CMB.2.raw
  modified_base (231)..(231): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccagggactggtgaagcccttggagaccctgtccctcacttgcagtgtctctggtnactccatcagtagtagtcataaagttttggggctgggtccgccgacgccccgaggggaagggctggagtggagttggggacttgtctactcgtaaggtcgggaccaccttattacacgccccgttcctacaacgacctccgactggtgacttcacaataaacaccgtaaccaaagtaacctaattcctaccctgacggactgaactctgtcgaccgcgacgacgacgactaaagtactagtactgacaaaggagacgggtccttaggaaaatttctccctttagaccccgtaagggtcggggtccttacgggggaaccccttgggtacctaacccggttcttcccttacgaaccgaccctaacccgacggaaccgggttccctaacgttcccgggtttcccccg

SEQ ID NO: 435581 - DNA, 693 bp, Homo sapiens
  misc_feature: GZ8MTXP01BAYX9.45.38.D05.1.454.CMB.2.raw
  modified_base (230)..(230): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtgggccctttctgccctgactcagcctgcctcgtgtctggtctcctggacagtcatcaccatggcctgcactacggaaccaangtgtagttggttaggggttatttttagtttgtactccgtacggtaaccaacaaccgacccggacgaaaccgaccccaaataatctaatttagaggacacgtagccggtccgtgggggttacagtcgtcttcgtactcggctacgtaacgtctacggacaacgaccggtccctacccgtagaactactccgtacgtcgggcctaccgagggtcctacgacgggacgtaggtctagttatttacgtttctgttcgcttacaattagtcgacggtacgggacaggtccgtaaggttcgggtacgttcggggacggtacggtaaccgtaggttaccggtacccggtcgttaacgggaccgaccggttacccgaaagggtccccgttacccggttcccccgtttgggaacccctttcgttcccggttcccgggttcccccttacccggttccttcccggttaacccgg

SEQ ID NO: 435582 - DNA, 675 bp, Homo sapiens
  misc_feature: GZ8MTXP01AI6PS.45.38.D05.1.454.CMB.2.raw
  modified_base (231)..(231): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactaggaaccaangtgagttggttgggtacgtttttagtttgtctcgtagtaccaacaaccgacccggacaaaccgacccctaaaactaactactaatttagaggacaacgtaacgccggtaccgttcgggggtttacaacgtcgtcttcgtcgtcggctaccgaagttccgtacggacaaccgaccggtccctaaccctagaacctaacgtccgtcgtacggggcctaccgacgggtctacgacgggacggacggtcttaggtatttacgtttcgtggttctctacattagtcgacggtaacgggacctaggtaccgttaggttcggggttcggttcggggacggggtacggtaccgtagggttcgaccggtccgtaggttaccgcgccgaacggccgttcccgttccccgttcggtaacctcgtcccgtccgtaccccttcccttccttcgtccg

SEQ ID NO: 435583 - DNA, 711 bp, Homo sapiens
  misc_feature: GZ8MTXP01EIH46.45.38.D05.1.454.CMB.2.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcatcaccatggcctgcactagaaccagagtgattggttgggttattttagttgtctctggtaaccaacaaccgacccggacgaacgacccccaaatactcaatttagaaggacacgtaagccggtcccgttacgggggtttcaaggtcccgtctttctctcggctacctaacgtcctacggacaaacgtccggccctacccgtagaactaactccgtcgtacgggcctccgagggtcctcgaagggaccgagggtcttagtaacttttatttcgttgttcgacttactagttatcgaggttaaggggttacgtttaaggttacgttttgggtacggttccggggtacgggaaacgggttacccgaagggtccgtacggaacccggttcgttaacgggccgtacggttaacccccggaaggtccccgttcccggttcccccccgttaacgggtcccttcccttccggtttcccccgttaacccccgaccccgttttcccttccgttccccgg

SEQ ID NO: 435584 - DNA, 655 bp, Homo sapiens
  misc_feature: GZ8MTXP01A4GDS.45.38.D05.1.454.CMB.2.raw
  modified_base (227)..(227): a, c, t, g, unknown or other
  modified_base (252)..(252): a, c, t, g, unknown or other
  modified_base (396)..(396): a, c, t, g, unknown or other
  modified_base (647)..(647): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatggcctgcactagaaccanagtgattggttgggtattttagttntctccgtagtaccaacgaccgaccccggacgaaaccgacccctaaatactctatttagaggacacgtacgcgtcctagtagggtttactaatcgtcttctcgtgacctcgaacgtcgtagaccaaccgtccggacccttacccngtaaccgtaactccgtacgtcgggtacctacccgaagggtcgtagggaacggtacgtaggtctaggtaactttacgtacgtgtctctacgttcataggtagacgtaaggtttacgttagttaccgtttggggacggtttcgggacggtacggaaccgacgtcgtcgtaaccggttccgttaggcccgtacgtaccccgacgttcgttccccggtccccgttagtcctacccgttccgttaccctttccccnccgttccc

SEQ ID NO: 435585 - DNA, 621 bp, Homo sapiens
  misc_feature: GZ8MTXP01EZ4AI.45.38.D05.1.454.CMB.2.raw
  modified_base (228)..(228): a, c, t, g, unknown or other
  modified_base (295)..(295): a, c, t, g, unknown or other
  modified_base (464)..(464): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcgatcaccatggcctgcactggaaccanagtgattggttggtattttagttgtctctgtaccaacacacccgacaacaccccaaatatcatttanaggacactaagcggaccgtcgggggtttcaagtcgcttatctggctcaagtctaggacaaccgacggtccctaccccgtagaactaaacgtcctacgtcggggtacctacgacgggctaggacgggacgtaggcttaggattttaataccgttggctggctagaaattntggggtactaagggttagtaagttacgttttgggtcggtttacggggacggtaaacggggccaaagtccgttgaacccgttcgttaaaggccacggacccgtagcgttccgccccgttcgactaaccttcgtacccttccctaaccttccgtaaccg

SEQ ID NO: 435586 - DNA, 733 bp, Homo sapiens
  misc_feature: GZ8MTXP01AV992.45.38.D05.1.454.CMB.2.raw
  modified_base (287)..(287): a, c, t, g, unknown or other
  modified_base (555)..(555): a, c, t, g, unknown or other
tcagacgcgatcgacacgaccggtgctcgatttagtatctgatagttggggtttgggggggggtcacaagaggcagcgctctcgggacgtctccaccatggcctgggctctgctgctcctcactctcctcactcaggacacagggtcctgggcccagtctgccctgactcagcctgccctcgtgtctgggtcctcgtggacagtcgatccaccatcctcctgcacgtacggaacctgctagtgtagttggttaggtattactaaccttgtcctacgtacggaccaanacgacctaacccgaggaaccccaaaaccgccccctaaatcctaagttacgtaagtttagacgggaacggtcaaacgggttaaccgcccggtaccccgtaggttaacgggtttaccaaacgttccgtacccttcctcgtacggtaccttaccaaaggttcccgtaacgaccaaacccgtcccggccccttaccgacgtaaacctacgttcccgtacggtcggtaccctacggtacggtccgtaagggacggtaacggtcgtaacggttnttaactttacgttacgcggggtactatcctacgtatacgtgaacggttacggttagttacggtttacgggtttgggcgggtaacgggtaccggacgtaccgttagtaccggtacgttacccggttcgaacgggtccaacgttaaccgccggtccacccgtccccgggttaattccccg

SEQ ID NO: 435587 - DNA, 527 bp, Homo sapiens
  misc_feature: GZ8MTXP02GYZ7Q.45.38.D05.1.454.CMB.2.raw
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggattttagtttgtctcctggtaccaacaacaccccggcgaacgcccccaaactaatcatttataggacactaagcggccctggggtttcaagtcgcttctctgctccaagtcctggcaacacggcctccctgacaatctctggctcagctcaggacgaggctgattattctgttgctcatatgcagggaccagcacgttgggtgttcggcggtagggaccaggttcgaccgtccgtaggtcacgcccaaggctcgccccctggtccactctcgttcccgcctcctctcg

SEQ ID NO: 435588 - DNA, 533 bp, Homo sapiens
  misc_feature: GZ8MTXP02JBEU5.45.38.D05.1.454.CMB.2.raw
  modified_base (529)..(529): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttggggattttagtttgtctcctggtaccaacaacaccccggcgaacgcccccaaactaatcaatttataggacactaagcggccctcggggtttcaagtcgcttctctgctcaagtcctggcaacacggcctccctgaccaatctctgggctccaggctcgaggacgaggctgatttatttctgttgctcatatgcagggaccagcacgttgggtgttcgggcgggaggaccagggttcgaccgtcgtaggtcacggcccaaggctcgcccctgcactctcgtcccacctccnctcg

SEQ ID NO: 435589 - DNA, 520 bp, Homo sapiens
  misc_feature: GZ8MTXP02I4Q95.45.38.D05.1.454.CMB.2.raw
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatggcctgcactggaaccaacagtgatgttgggattttagttgtctctgtaccaacaacacccggcaacgccccaaactatcatttataggacactaagcggccctcggggtttcaagtcgcttctctggctcagtcctggcaacacggcctccctgcaatctctgggctcaggctcaggacgaggctgatttatttctgttgctcatatgcagggaccagcacgttgggtgttcggcggagggcctagggtcgaccgtccgtaggtcacgcccgaaggcctcgcccctggtccactctcgttcccgcctctctcg

SEQ ID NO: 435590 - DNA, 548 bp, Homo sapiens
  misc_feature: GZ8MTXP02HWHYO.45.38.D05.1.454.CMB.2.raw
  modified_base (444)..(444): a, c, t, g, unknown or other
  modified_base (459)..(459): a, c, t, g, unknown or other
  modified_base (473)..(473): a, c, t, g, unknown or other
  modified_base (521)..(521): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctgggtccgccagcccccgaggaaggggctggagtggattgggactgtctactctagtgggaccaccttattacagcccgtccctcaacgaccctcgactggtgatcctacataaacacgtaccaaagaaccaattctccctgaggctagaactctagtgacccgcgcgacacggaccaaattnttactgtgacaaagngagggctggaattntccttagacacgttcggggcctagggaaccctggtcaccgtctcgtcncgctccaccaacggcccactcggtccc

SEQ ID NO: 435591 - DNA, 536 bp, Homo sapiens
  misc_feature: GZ8MTXP02H1IDT.45.38.D05.1.454.CMB.2.raw
  modified_base (228)..(228): a, c, t, g, unknown or other
  modified_base (275)..(275): a, c, t, g, unknown or other
  modified_base (298)..(298): a, c, t, g, unknown or other
  modified_base (525)..(525): a, c, t, g, unknown or other
  modified_base (531)..(531): a, c, t, g, unknown or other
tcagacgcgatcgacacgaccggtgctcgatttagtatctgatagttgggtttggggggtcacaagaggcagcgctctagggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaangtgatgttgggattttagtttgtctctggtaccaacaacaccccggnaacgaccccaaataatcatttanaggacactaagcggccctggggtttcaagtcgcttctctgcctcaagtcctggccaacgaccggcctccctagactaatctcgtgggcctccgagctcgagacgagctagatttattctgtgctcatatgctaagggcagcacgttgggtcgttcggcggagggacctagggtcgaccgtcgtaggtcacgaccgaacgctacgtccccgtggcactctccgtcccnccttcnctacg

SEQ ID NO: 435592 - DNA, 599 bp, Homo sapiens
  misc_feature: GZ8MTXP02IFDHB.45.38.D05.1.454.CMB.2.raw
  modified_base (228)..(228): a, c, t, g, unknown or other
  modified_base (267)..(267): a, c, t, g, unknown or other
  modified_base (272)..(272): a, c, t, g, unknown or other
  modified_base (276)..(276): a, c, t, g, unknown or other
  modified_base (293)..(293): a, c, t, g, unknown or other
  modified_base (332)..(332): a, c, t, g, unknown or other
  modified_base (429)..(429): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcgatcaccatggcctgcactggaaccaangtgattgttgggtattttagtttgctctgtaccacaacncccgnaacnccccaaatatcatttanaggacactaagccggcccgtggggtttcaagtcgctttnctggctccaagtcctggcaacgcgcctcctgacatctcgtgggcctccgaggcctcgaggacgaggtctaggtaactttatttcgtagttcgcttanagtagtcgacgaggtacaggtcgttaggttcggggttcgttacggggacgggtacggtaccgtagggttcgacccggttacgtaggtccgacgacccgtacggtcccgtcccgtccccgtcggtaacctacccgttccgttcccgttccccgtacccttccgtacgtccg

SEQ ID NO: 435593 - DNA, 575 bp, Homo sapiens
  misc_feature: GZ8MTXP02GF6MP.45.38.D05.1.454.CMB.2.raw
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggattttagtttgtctcctggtaccaacaacaccccggcgaacgcccccaaactaatcatttataggacactaagcggccctcggggttcaagtcgcttctcagctccaagtcctggcaacacggctccctgacaatctctgggcctccaggctcgaggacgaggctgattattctgttgctcatagtgcgagggaccagctacgttggggtgttcgggcggtacgggaccgtagggttcgaccggttccgtaagggtccacgacccgaaacggccgtccgcccccgttcggtcctaccgttccgtccgttacccccacccttccctaccgttccg

SEQ ID NO: 435594 - DNA, 530 bp, Homo sapiens
  misc_feature: GZ8MTXP02JZL5E.45.38.D05.1.454.CMB.2.raw
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagtttgtctctggtaccaacaacaccccggcaacgcccccaaactaatcatttataggacactaagcggccctggggtttcaagtcgcttctctgctcaagtcctggcaacacggcctccctgcaatctctgggctccaggctcgaggacgaggctgattatttctgtttgctcatatgcagggaccagcacgttgggtgttcgggcggagggaccagggttcgaccgtcgtaggtcacgtcccaaggctcgcccctcgcgactctcgtcccgcctcccgctcg

SEQ ID NO: 435595 - DNA, 550 bp, Homo sapiens
  misc_feature: GZ8MTXP02GQQG2.45.38.D05.1.454.CMB.2.raw
  modified_base (230)..(230): a, c, t, g, unknown or other
  modified_base (428)..(428): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaatttggggctgggtccgcagccccagggagggctggagtggattgggactgtctactctagtggaccactattacacgcccgtcctcaagaccctcgactggtgatctacataaacacgtaccaagaaccaattctccctgagtctgaactctgtcgaccgcgcgacacgcaaatntactgtgacagagaggctaggattactcttagactacgtcgggccgtagggaacccttgggtaccaccggtcctcctccgaagcccctacgaccgaacgggccctacgtccggtttcccccg

SEQ ID NO: 435596 - DNA, 625 bp, Homo sapiens
  misc_feature: GZ8MTXP02HXCUV.45.38.D05.1.454.CMB.2.raw
  modified_base (229)..(229): a, c, t, g, unknown or other
  modified_base (309)..(309): a, c, t, g, unknown or other
  modified_base (386)..(386): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgattggttggggtatttttagtttgtctcctggtaccaacaaccaccccggcgaaacgcccccaaataatcatttanagggacactaagccggccgttcggggtttcaagtcgcttctctggctcgaagtccctggaccaacaccggcctcccngaccaatctcgtgggcctccgagcctcgaggacgagctagatttattcgtgttcgctactattagtcgacgacgggtaccaggtcctacggtttggggtcgttcggggacgggtagggacccgtagggttcgacccggttcgtacggtcgaccgtacccgaaacggtccgtcccgtcccccgttcggtccctaccgttccgttcccgttcccccgtcccccttaccgttcccgtcccgg

SEQ ID NO: 435597 - DNA, 525 bp, Homo sapiens
  misc_feature: GZ8MTXP02GXKA0.45.38.D05.1.454.CMB.2.raw
tcagacgcgatcgacacgaccggtgctcgatttagtatctgatagttgggtttggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagatgtctctggtatcagcaacacccaggcaaacgcccccaaatcatcatttatgatgtacaataatcggccctcgtaggggtttctcatcgtcttcctctgctcaagtctggcaatacggcctccctgaccatctctggctcgagctgagcgagctgattatactgcagcacatatattagtgttcacgtcggtattcgggcggtaggacctaaggttcgtaccgtacgtacggtcacgtcccgaagtctaccgccccgtggtcctaccgtcttcccg

SEQ ID NO: 435598 - DNA, 507 bp, Homo sapiens
  misc_feature: GZ8MTXP02GCLW7.45.38.D05.1.454.CMB.2.raw
  modified_base (226)..(226): a, c, t, g, unknown or other
  modified_base (401)..(401): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggagttataacttgtctctgtacacagcaccaggcaaacgccccaaactcatgatttatgaggcagtaagcgcctcgaggggtttctaatcgccttctctgctcagtctggcacacgcctcctgacatctctggctcgaggctgaggacgagctgattattacngctgctcatatgcgtaggtagtagttacgtttggtgttcgggcggagggaccaagcgtacgaccgtctacggtcacggacccaaggcctccgtcccctcggttccc

SEQ ID NO: 435599 - DNA, 582 bp, Homo sapiens
  misc_feature: GZ8MTXP02HVUZ5.45.38.D05.1.454.CMB.2.raw
  modified_base (313)..(313): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtctataaatttggggctggtccgccagcccccgagggagggctggagtggagtgggactgtctactntagtgggaccactattacacgcccgtcctcaagaccctcgactggtgatcacataaacacgtaccaaagaacctaacttctaccctgacgctagactctgtcgaccgccgacggaccacggaccaaatacttactgtgacaaggagacgggcctaggtaatcttaccgtttagaccctaacggtcgggggacccttacggggaaaccccttgggtaccacccggttctccgtcaacgtcctacccacgaacggcccagttccggtcccc

SEQ ID NO: 435600 - DNA, 575 bp, Homo sapiens
  misc_feature: GZ8MTXP02JBI9M.45.38.D05.1.454.CMB.2.raw
  modified_base (229)..(229): a, c, t, g, unknown or other
  modified_base (291)..(291): a, c, t, g, unknown or other
  modified_base (344)..(344): a, c, t, g, unknown or other
  modified_base (409)..(409): a, c, t, g, unknown or other
  modified_base (412)..(412): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttggtattttgttgtctctgtaccacacacccgcaacgccccaactatcatttanaggacactagccgcccgtcggggttcagtcgcttctctgctcagtcctgcacncgcctccctgacatctgtcgggcctcgagtctgacgggacgaggtctgtattattactgctgctnatntgctaggtagtagttacgtttggtgttcgggacggtacggacctaaggccgtacggtacccgtccgttaagggccaacggaccccgtaacggtccctcccggtcccccgttcgggtaccctaccgttcccgttccgttcccccctacccctttccctttcccg

SEQ ID NO: 435601 - DNA, 529 bp, Homo sapiens
  misc_feature: GZ8MTXP02JHOS5.45.38.D05.1.454.CMB.2.raw
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggattttagtttgtctcctggtaccaacaacaccccgacgaagcccccaaactaatcatttataggacactaagcggcctgggggtttcaagtcgcttctctggctccaagtcctggcaacacggcctcctgcaatctctgggctccagctcaggacgaggctgattattctgttgctcatatgcagggaccagcacgttgggtgttcggcggagggaccagggttcgaccgtctagggtccagcccaaaggcctcgccccctggtcactctcgttccccgcctcctctccg

SEQ ID NO: 435602 - DNA, 559 bp, Homo sapiens
  misc_feature: GZ8MTXP02FQAD5.45.38.D05.1.454.CMB.2.raw
  modified_base (418)..(418): a, c, t, g, unknown or other
  modified_base (425)..(425): a, c, t, g, unknown or other
tcagacgcgatcgacacgaccggtgctcgatttagtatctgatagttgggtttggggagggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttggggtagtttagtttgtctcctggtaccaacaacacccggcgaacgccccaaactaatcatttataggacactaagcggcctcggggttcagtcgcttctctggctcaagtctggcaacacgcctcctgacaatctctgggctccaggctcgaggacgaggctgacttatttctgtttnctcatangacgaggaccagcgtacgttggggtcgtcgggcgggagggaccgtagggttacggaccgtcgtacggtcgacgacccgaacgtcctccgcccccgtcggtcctaccgttccgtccgttccccgcccttcctccg

SEQ ID NO: 435603 - DNA, 554 bp, Homo sapiens
  misc_feature: GZ8MTXP02FUKKL.45.38.D05.1.454.CMB.2.raw
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtagtttttagtttgtctctggtaccaacaacacccggcgaacgcccccaaataatcatttataggacactaagcggtccctcggggtttcaagtcgcttctctgctcagtcctggcaacacggcctccctgaccaatctcgtgggcctccgaggctcgaggaccgaggctgtatttatttcttgttgctacattatgcagggaccagctacgttgggtgttcggcgggtaggaccgtaggttcgaccgttcgtaggtcacgcccaaggtcctcgccccctcggtccacgtcgtccgttccccgccctcctctccg

SEQ ID NO: 435604 - DNA, 571 bp, Homo sapiens
  misc_feature: GZ8MTXP02HYHJ1.45.38.D05.1.454.CMB.2.raw
  modified_base (452)..(452): a, c, t, g, unknown or other
  modified_base (459)..(459): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtctataaagttttggggctgggtccgccacgcccccgaggggaaggggctggagtggattgggactgtctactctagtgggaccactattacacgccgtccctcaagaccctcgactggtgatctacataaaccacgtacctaaagaaaccctaattcctccctagacgctagaactctgtacgaccgcgacgacacgacaaagtntactgtnacaagagaggcctaggtaattcgtccgtttagacgtacgtcggggcctacgggaaccctggtaccaccgtctcctcgcgccctaccgaccgacggcccagttcccggtcccc

SEQ ID NO: 435605 - DNA, 596 bp, Homo sapiens
  misc_feature: GZ8MTXP02G8LHC.45.38.D05.1.454.CMB.2.raw
  modified_base (229)..(229): a, c, t, g, unknown or other
  modified_base (302)..(302): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcgatcaccatggcctgcactggaaccaacngtgatggttgggtattttagtttgtctcctggtaccaacaacacccggcgaacgcccccaaatatcaatttanaggacactaagcggccgtcggggtttcaagtcgcttctctgctcagtcctggcaacgaccggcctccctgactaactctcgtgggcctcgaggctcgaggacgagctgtatttatttctgttcgctcatatgacgtacgggacagtcgtacgttggggtcgttcggggacggtacgggaccgtagggttcgacccggttacgtacgggtccacggaccccgaaacggccgttccggcccccgttacgggtcctaccgttcctccggttccccctaccccttccctacgtcccgg

SEQ ID NO: 435606 - DNA, 525 bp, Homo sapiens
  misc_feature: GZ8MTXP02GTPJB.45.38.D05.1.454.CMB.2.raw
  modified_base (228)..(228): a, c, t, g, unknown or other
  modified_base (371)..(371): a, c, t, g, unknown or other
  modified_base (443)..(443): a, c, t, g, unknown or other
  modified_base (513)..(513): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccanagtgatgttgggattttgtttgtctctggtaccaacaacacccggcaacgccccaaataatcatttataggacactaagcggcctcggggttcaagtcgcttctctggctccaagtcctggcaacacggcctcctgcatctcnggctcagctcaggacgaggctgattattctgttgcttcattatgcagggaccagctacgttgggtgttcggnggacggccgaggttcgaccgtcgtaggtcacgcccaaggcctcgcccccgtggtccacgtctcgtacccnccctctccgtcg

SEQ ID NO: 435607 - DNA, 549 bp, Homo sapiens
  misc_feature: GZ8MTXP02FS8RA.45.38.D05.1.454.CMB.2.raw
  modified_base (230)..(230): a, c, t, g, unknown or other
  modified_base (434)..(434): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaatttggggctggtccgccagcccccgagggaaggggctggagtggattgggactgtctactctagtgggaccacctatacagcccgtcctcaagacctcgactggtgatctacataaacacgtaccaaagaaccaattctaccctgacgctgaactctgtcgaccgcgcgacacggcaaatnttactgtgcaagagacgggcctaggaattatcctttagactacgtacggggcctaggggaaccctgggtcaccgtctccctcaacgcctaccgaccgacggccacgtccggtccc

SEQ ID NO: 435608 - DNA, 544 bp, Homo sapiens
  misc_feature: GZ8MTXP02IG2A1.45.38.D05.1.454.CMB.2.raw
  modified_base (229)..(229): a, c, t, g, unknown or other
  modified_base (302)..(302): a, c, t, g, unknown or other
  modified_base (331)..(331): a, c, t, g, unknown or other
  modified_base (336)..(336): a, c, t, g, unknown or other
  modified_base (355)..(355): a, c, t, g, unknown or other
  modified_base (364)..(364): a, c, t, g, unknown or other
  modified_base (412)..(412): a, c, t, g, unknown or other
  modified_base (450)..(450): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttggtattttagtttgtctctggtaccaacaacacccggcgaacgcccccaaatactctaatttanaggacactagcggccctggggttcagtcncttcnctgctcagtcctggcaacncggcctccngcatctcgtggcctcgagctcgaggcgagctgatttattctgttgctnatatgacgacgggtaccagctacgttgggagttcgggnggacggtacaggttcgaccggtctagggtcacgtacccgaacggctccgccccgtcggtcctacgtccgtccttccccgcccttccgtctaccg

SEQ ID NO: 435609 - DNA, 593 bp, Homo sapiens
  misc_feature: GZ8MTXP02F20NE.45.38.D05.1.454.CMB.2.raw
  modified_base (305)..(305): a, c, t, g, unknown or other
  modified_base (360)..(360): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcacatggcctgcactggaaccaacagtgatggttggggtatttttagtttgtctcctggtaccaacaacaccccggcgaacgcccccaaataatcatttanaggacactaagcggccgtggggtttcaagtcgcttctctgctcagtcctgcaacncgcctcctgacatctcgtgggcctcgaggctcgaggacgaggctgatttattctgttgctcatagtcgcgtacgggaccagtcgtacgttggggtcggttcgggcgggacggggactagggttcgaacccggttcgtacggtaccgacggaccccgaaaggtcccgtccgtcccccgttcggtaaccgtaccttccggttccgtttcccccgcccctttacccgtcttcccgg

SEQ ID NO: 435610 - DNA, 529 bp, Homo sapiens
  misc_feature: GZ8MTXP02IYRI6.45.38.D05.1.454.CMB.2.raw
  modified_base (226)..(226): a, c, t, g, unknown or other
  modified_base (264)..(264): a, c, t, g, unknown or other
  modified_base (270)..(270): a, c, t, g, unknown or other
  modified_base (291)..(291): a, c, t, g, unknown or other
  modified_base (323)..(323): a, c, t, g, unknown or other
  modified_base (343)..(343): a, c, t, g, unknown or other
  modified_base (381)..(381): a, c, t, g, unknown or other
  modified_base (391)..(391): a, c, t, g, unknown or other
  modified_base (393)..(393): a, c, t, g, unknown or other
  modified_base (397)..(397): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcacatggcctgcatggaaccanagtgatgttggtattttagttgctctgtaccaacaacncccganaacaccccaaatatcatttanaggacactaagcgccgtggggttcagtcgctnctgctcaagtcctagcaacncgctccagacatctctcggctacaggctacgaggacgngctagtattntntgtntctatatatgagacgacgagacgtacgtggtcggtacggacggacggacgtacgtacgtacgtacgtacgacgacgacgacgtccgtccgtcccgtccgtccgtactctcctacccgtaccctcctacgtcg

SEQ ID NO: 435611 - DNA, 553 bp, Homo sapiens
  misc_feature: GZ8MTXP02HS52W.45.38.D05.1.454.CMB.2.raw
  modified_base (304)..(304): a, c, t, g, unknown or other
  modified_base (533)..(533): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttggggtatttttagtttgtctcctggtaccaacaacaccccggcgaacgcccccaaataatcatttanaggacactaagcggccctggggtttcaagtcgcttctctgctcaagtcctggccaacaccggcctcccctgacctaatcctcgtcgggcctccgaggtcctcgaggacgaggctggtatttatttctgttgctacatatcgacgacgggaccagtctacgttggggtgttcgggcggagggaccgtaggttcgaccgtcgtaggtcacgccgaacgctcgcccctgtcnctcgtctcccgcctctctcg

SEQ ID NO: 435612 - DNA, 556 bp, Homo sapiens
  misc_feature: GZ8MTXP02J0WFF.45.38.D05.1.454.CMB.2.raw
  modified_base (230)..(230): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaatttggggctggtccgccagcccccgagggaagggctggagtggattgggactgtctactctagtgggaccactattacagcccgtccctcaagaccctcgactggtgatctacataaacacgtaccaaagaaccaattctccctgacggctagaactctgtcgacccgccgacggaccacggaccaaatattactgtgacgaagagaggcctaggtaattactcctttgaccacgtcggggcctagggaccctggtccaccgtctcctcaacgccctaccgaccacggcccacgtccggtccc

SEQ ID NO: 435613 - DNA, 596 bp, Homo sapiens
  misc_feature: GZ8MTXP02F17I2.45.38.D05.1.454.CMB.2.raw
  modified_base (392)..(392): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctggtccgccagcccccgagggaagggctggagtggattggactgtctactctagtgggaccacctattacacgcccgtcctacaacgacctcgactgtgatctcataaacacgtaccaaagaaccaattcnccctagaggctgaactctgtgacccgcgacggacacggaccaaagttataactgtacgcgaaagagacgggcctaggtaattaatcccgtttagaacccgtacgtcggggcccgttacggggaaaccccttgggtaccctaccggtccttcccgtcgaacgcccctaccaaccgaccgggaccccaacgttccggtttcccccg

SEQ ID NO: 435614 - DNA, 645 bp, Homo sapiens
  misc_feature: GZ8MTXP02JFIGS.45.38.D05.1.454.CMB.2.raw
  modified_base (226)..(226): a, c, t, g, unknown or other
  modified_base (447)..(447): a, c, t, g, unknown or other
  modified_base (478)..(478): a, c, t, g, unknown or other
  modified_base (607)..(607): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatgcctgcactggaaccaanagtgattggttggtagtttttagtttgtctcgtaggtaccaacaaccgacccggacaaccgaccccaaatatctaatttagaggacaacgtaaggccggtacccgttacgggggtttacaacggttccgtcctttcgtcgtcggtcctaccgaagtccgtacggaccaaaccgccggtccctacccgtagacctaattccgtacgtcggcctccgaggtcncgaaggacgtaggcttagtaatttcttcgtntttcgcctatattagtcgacgacgggaccaggtccgtaggttgggtcggtacgggcggagggtacctagggttcgaacccggttcgtaggtccaacgcccgtaaggtccctaccgccccttcggtaacncctttccgtccgttaccccacccttcccgtacttcccg

SEQ ID NO: 435615 - DNA, 595 bp, Homo sapiens
  misc_feature: GZ8MTXP02F4OS7.45.38.D05.1.454.CMB.2.raw
  modified_base (230)..(230): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcattaaagtttggggctggtccgccacgccccgagggaagggctggagtggagttgggactgtctactcgtagtcgggaccacctattacacgtcccgtccacaacgacctcgactggtgatctacataaacacgtaccaaagaacctattcctccctagagtcctagaactctgtcgaccgcgcggacacggccaaaattacttactggtagacgaaagtagacgggtaccgtaggtaattacgttcctttagacccgtacgtcgggggcccttacgggaaccctggtaccaccgtcctcctcgaacgtccctaccgaccgtaacggccctacgtccggttcccccg

SEQ ID NO: 435616 - DNA, 607 bp, Homo sapiens
  misc_feature: GZ8MTXP02G1HOP.45.38.D05.1.454.CMB.2.raw
  modified_base (299)..(299): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactgaaccacagtgatgttgggattttagtttgtctcctggtaccaacaacaccccggcgaacgcccccaaataatcatttanaggacactaagcggccctcggggtttcaagtcgcttctctggctccaagtcctggacaacgacggcctccctgaccaatctcgtgggcctaccgaggcctaccgaggaccgaggctgtaactttatttcgtgtttgctcaatatgcgagggaccagctacgttgggtgttacgggcgggagggcccgaagggtttgaacccgttcgtacggtacaccggacccgaaagggtccgtccggaccccccgttcgggtccctaccgttcccgttccgggtttcccccgccccgtttccctaccgtttcccgg

SEQ ID NO: 435617 - DNA, 557 bp, Homo sapiens
  misc_feature: GZ8MTXP02IRMZA.45.38.D05.1.454.CMB.2.raw
  modified_base (347)..(347): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (525)..(525): a, c, t, g, unknown or other
tcagacgcgatcgacacgaccggtgctcgatttagtatctgatagttgggtttgggagtgctttcttgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctggtccgccagccccccagggaaggggctggagtggagtttgggactgtcactctagtgggaccacctattacagcccgtccctnaagaccctcgactggtgatctacataaacacgtaccaaagaaaccaattctcccagtaggctagaaactctgtgacccgcgacggacacggaccaaaatnttaacngtnacaagagacgggcctaggaattactcttagaccagtcggggctcgggaacctggtcaccgtcctcctcncgcctaccaccaagggcccacgtcggttcccc

SEQ ID NO: 435618 - DNA, 544 bp, Homo sapiens
  misc_feature: GZ8MTXP02GD3BX.45.38.D05.1.454.CMB.2.raw
  modified_base (299)..(299): a, c, t, g, unknown or other
  modified_base (355)..(355): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtatttttagtttgtctctgtaccaacaacacccggcaacgccccaaatatcatttanaggacactagcggcccgtcggggtttcaagtcgcttctctgctcagtcctgcaacncggcctcctgacatctcgtggcctcgaggctcgaggacgagctgtatttattctgttgctcgatagtgcgacgggaccagctacgttgggtgttcgggcggacggaccgtaggtcgaccgtcgtaggtcacgccgaacggtcctccgccccgttcggcctacgtctccgttccccaccctccgtctccg

SEQ ID NO: 435619 - DNA, 588 bp, Homo sapiens
  misc_feature: GZ8MTXP02G0LPK.45.38.D05.1.454.CMB.2.raw
  modified_base (303)..(303): a, c, t, g, unknown or other
  modified_base (376)..(376): a, c, t, g, unknown or other
  modified_base (447)..(447): a, c, t, g, unknown or other
  modified_base (574)..(574): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggagttttagtttgtctcctggtaccaacaacaccccggcaacgcccccaaataatcatttanaggacactaagcggccctggggtttcaagtcgcttctctgctccaagtcctggaccaacgaccggccctcccngacctaatctacgtggggcctccgaggcctcgacggacgagctgtatttatttctgttgtctcatttttangtcgacgggtaccagcgtacgttgggttggtcgggcgggacgggtaccgtaggtcggaccgtcgtacggtcgtacgcccgaacggccgtccgtcccccgtcggtcctaccgtccgtccgttaccccncccttcctctaccg

SEQ ID NO: 435620 - DNA, 532 bp, Homo sapiens
  misc_feature: GZ8MTXP02I6757.45.38.D05.1.454.CMB.2.raw
tcagacgcgatcgacacgaccggtgctcgatttagtatctgatagttgggtttggggggtcgacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagtttgtctcctggtaccaacaacaccccggcaacgcccccaaactaatccaatttataggacactaagcggccctggggtttcaagtcgcttctctggctcaagtcctggcaacacggcctccctgacaatctctgggcctccgaggctcaggacgaggctgattatttctgttgctcatatgcagggaccagcacgttgggtgttcggcgggagggaccaggttgccgtcgtaggtcacgcccgaaggctcgcccctggcacgtctcgtcccgccctctctcg

SEQ ID NO: 435621 - DNA, 594 bp, Homo sapiens
  misc_feature: GZ8MTXP02F81JW.45.38.D05.1.454.CMB.2.raw
  modified_base (367)..(367): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccgagggaaggggctggagtggattgggactgtctactctagtgggaccactattacagcccgtcctcaacgacctcgactggtgatctnataaacacgtaccaagaaccaaattcctaccctgacggctgaaactctgtcgacccgcgacgaaccaccgggacaaaagtattaccgtgtagacaaaggagaacgggcctaggtaaattacgtcctttgacctacgtcggggtaccgttacggggaacccttggtaccgacccgttctccgtccaacggcccttaccaccgaacgggccccacgttccggttacccc

SEQ ID NO: 435622 - DNA, 622 bp, Homo sapiens
  misc_feature: GZ8MTXP02JY7CN.45.38.D05.1.454.CMB.2.raw
  modified_base (342)..(342): a, c, t, g, unknown or other
tcagacgcgatcgacacgaccggtgctcgatttagtatctgatagttgggtttggggacggacctcctgtgcaggaaaatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagccccgagggagggctggagtggattgggactgtctactctagtggaccacctattacacgcccgtcctcaacgactcgactggngatctcaataaaccacgtaccaagaaccaattcctcctgacggtctagaactctgtcgacccgccgacggacacggaccaaagtattactgtgacaagagacgggcctagggtaaatttactccgtttagaccgtacgtcggggcccttacgggggaaccccttgggtacccaccggttcctcccgtacgacggccctacccgaaccgacgggtccccacgttccggtcccttcccccgtcggaccctaccccgttccctacccgaaacggtacgccccg

SEQ ID NO: 435623 - DNA, 544 bp, Homo sapiens
  misc_feature: GZ8MTXP02G1MVL.45.38.D05.1.454.CMB.2.raw
  modified_base (228)..(228): a, c, t, g, unknown or other
  modified_base (268)..(268): a, c, t, g, unknown or other
  modified_base (282)..(282): a, c, t, g, unknown or other
  modified_base (289)..(289): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccangtgatgttggatttgttgtctctgtaccaacacacccggnaacgccccaaatancatttanaggacactaagcggccctggggtttcaagtcgcttctctggctccaagtcctggcaacacggcctccctgcaatctctgggcctcaggctcgaggtacgaggctgaatttattctgttcgctcatatgcagggacagctacgtgggtgttcgggcggagggacctagggtcgaccggttcgtaaggtccacgcccgaacggcctaccggcccccgtggtcctactccgttcgttcccccacccgttcctcgtccg

SEQ ID NO: 435624 - DNA, 607 bp, Homo sapiens
  misc_feature: GZ8MTXP02H7LOH.45.38.D05.1.454.CMB.2.raw
  modified_base (228)..(228): a, c, t, g, unknown or other
  modified_base (302)..(302): a, c, t, g, unknown or other
  modified_base (344)..(344): a, c, t, g, unknown or other
  modified_base (363)..(363): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgattgttgggtatttttagtttgtctctggtaccaacaacaccccggcaacgcccccaaatatcaatttanagggacactaagccggtccccgtggggtttcaagtcgcttcnctgctcaagtcctgcaacncggcctcctgacatctcgtgggcctccgaggctcgaggacgaggctgatttatttctgttgctactattatgacgacgggtaccagtccgtacgtttggggtcggttcgggacgggtacgggaccgtagggtttcgacccggttcgtacgggtccgacggacccgaacgggtcctcccggtcccccgttacggtcctaacccgttccgttacccgttccccctaccccgtttcccgtacgtccg

SEQ ID NO: 435625 - DNA, 620 bp, Homo sapiens
  misc_feature: GZ8MTXP02GDAR7.45.38.D05.1.454.CMB.2.raw
  modified_base (232)..(232): a, c, t, g, unknown or other
  modified_base (376)..(376): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccgtatgcgtcctgtcccagctgcacctgcaggagtcgggcccaggactggtgaagccttcggagacccctgtcccctcacttgcagtgtctctggtnactccatcagtagtagtcaattaaagttttggggctcgggtccgccgacgcccccgaggggaacggggctggagtggagtttgggacttgtctactcgtagtggaccacttattacacgcccgtcctcaagccctcgactggtnactctacaactaacacgtaccaaacgaacctaattcctcccgtagacggtctagaactctgtcgacccgcgacgactacggaccaaaagttctacgtgtagacgaagaggacggccgtaggtaattacgttcttacgaccgtacggttcggggaccgtacggggtaaaccctcggggtacctacccgtccttccctcgaaccgtccctaccgaaaccgacgggaccctacgttcccggttcccc

SEQ ID NO: 435626 - DNA, 660 bp, Homo sapiens
  misc_feature: GZ8MTXP02HGDZW.45.38.D05.1.454.CMB.2.raw
  modified_base (230)..(230): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcaataaatttggggctgggtccgcagcccccagggaagggctggagtggattgggactggtctactcgtagtgggaccaccgtattacacgtcccgtcctacaagacctcgactggtagatcgtcataaacacgtccaaagaacctaatctcccgtagacggctagaactctgtcgacccgcgcggaaccaccggaccaaaaagttcttaacgtgttacgacgaagggaacgacgggtccctaagggtaaacttacgttccgtttacgaacctacgggtacggggtaccctacgggggtaaaccccctgggtacccctaaccggttccctacccgttaccggaacgtacccccgttaccgaaaccccgaaaaccggggtcccccttaaacggttccccggggtttaccccccg

SEQ ID NO: 435627 - DNA, 772 bp, Homo sapiens
  misc_feature: GZ8MTXP02INGTG.45.38.D05.1.454.CMB.2.raw
  modified_base (227)..(227): a, c, t, g, unknown or other
  modified_base (305)..(305): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcaccatggcctgcactggaaccaangtgattggttggtagtttttagtttgtctctggtaaccaacaaccacccggcgaacgacccccaaatatctaatttanaggacaacgtaagccggtcccgttggggtttacaacgtcgtcttctcgtggcctacgaagtcccgtaggacctaaacgaccggtcccctcccgtagacctaacttccgtccggtcggggtcccttaccgaacgggtcccgtacgaacggggaccggtaagggtccgttaggttaactttttaacttttccgttggtttcgtccttactaagtttacgttacggaccggtaaacgggggacccctaagggtccgttaaccgggtttcgggggttacggtttccgggggaccgggggtaaacgggggtacccgttacggggttacggtaacccccgggttaccgttacggggtaccgaacccgggttaaccccgaaacggggtcccgttaccccggtcccccgtttccgggtaacctacccgtttcccgtttccccggttcccccgtcccctttcccgtaccttcccgg

SEQ ID NO: 435628 - DNA, 615 bp, Homo sapiens
  misc_feature: GZ8MTXP02FYF9S.45.38.D05.1.454.CMB.2.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttggggtattttagtttgtctcctggtaccaacaacaccccggcgaacgcccccaaataatcatttataggacactaagcggcctcggggttcagtcgcttctctgctcagtctgcaacacggctccctgcaatctctgggcctcgaggctcgaggaccgaggctgtatttattctgttcgctcatagtgcgtagggaccagcgtacgttggggtacgttcgggacggggtacgggaccgtaagggtttcggacccgttaccgtacgggtaccgacggacccccgtaaggggtcccttaccggcccccccgttcgggtaaccctacccgttcccgtttaccggttttcccccgtacccgtttcccctaccgtttcccgg

SEQ ID NO: 435629 - DNA, 595 bp, Homo sapiens
  misc_feature: GZ8MTXP02GEPDM.45.38.D05.1.454.CMB.2.raw
  modified_base (229)..(229): a, c, t, g, unknown or other
  modified_base (297)..(297): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacngtgatgttgggtattttagtttgtctctggtaccaacacacccggcaacgccccaaatatctatttanaggacactaagcggccgtcggggtttcaagtcgcttctctggctccaagtccctggcaacgaccggccctccctgacctaatcctacgtcgggcctccgaggcctcgaggaccgaggctagtatttattcgtgttcgctcattagtgacgacgggtaccagtctacgttgggtcggttcgggacgggagggaccgtagggttcgaacccgtcgtaagggtcacggacccgaacggtcctaccgtcccccgttacggcctaccgttccgttccgttcccccgcccttccgttccgtccg

SEQ ID NO: 435630 - DNA, 527 bp, Homo sapiens
  misc_feature: GZ8MTXP02HKBRE.45.38.D05.1.454.CMB.2.raw
  modified_base (297)..(297): a, c, t, g, unknown or other
  modified_base (429)..(429): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggagttataccttgtctctgtaccacagcaccagcaaacgccccaaatcatgattangaggcagtagcgcctgagggttctatcgccttctctgctcagtctgcaacacgcctcctgacatctcgtcggctccgaggctgacggacgaggtctagtatttattctagttgtctcattatgcgacggacngacgtagttggggtcgttcgggcgggacgggtaccgtagggttcgaccgttccgtaggtccaacgccgaacggtcctccgcccccgtcggtacctccg

SEQ ID NO: 435631 - DNA, 531 bp, Homo sapiens
  misc_feature: GZ8MTXP02GH81L.45.38.D05.1.454.CMB.2.raw
  modified_base (227)..(227): a, c, t, g, unknown or other
  modified_base (274)..(274): a, c, t, g, unknown or other
  modified_base (383)..(383): a, c, t, g, unknown or other
  modified_base (416)..(416): a, c, t, g, unknown or other
  modified_base (420)..(420): a, c, t, g, unknown or other
  modified_base (429)..(429): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcatcacatggcctgcatggaaccaacngtgatgttgggattttagtttgtctctggtaccaacaacaccccggngaaagcccccaaaactaaatcaatttaatagggacactaaagcggtcctggggtttcaaagtcgcttctctggctcaagtccctggcaaacacgcctcctgacaaatcntgggctcagctcagcgagctgattatactgcanacanatatatatntctacgtagtagtcggacgacgacgaagtagtacgtacgtacgtacgacgaccgacgacgtccgccctccgtctaacgtctcgtccctccctcctctcgtcg

SEQ ID NO: 435632 - DNA, 568 bp, Homo sapiens
  misc_feature: GZ8MTXP02JU8ZZ.45.38.D05.1.454.CMB.2.raw
  modified_base (264)..(264): a, c, t, g, unknown or other
  modified_base (294)..(294): a, c, t, g, unknown or other
  modified_base (421)..(421): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggattatacttgtctctgtaccaacngcaccagacaacgccccaaatcatgattangaggcagtagcgcctcgtagggttctatcgccttctctgctcagtctggcaacgccgcctcctgactactctcgtcggcctcgaggctaggacggacgaggctagatttatactgtctagctcaatntcgacgtagggttagttaggtttacgtttggggtacggtttcgggacggggtaacggtaccgtaaaggtccgtacggtaccccgttaccgtaggtaacccgaacgaccccggaacggtcccgtacccggtacccccgttaggtcccc

SEQ ID NO: 435633 - DNA, 669 bp, Homo sapiens
  misc_feature: GZ8MTXP02JHJE5.45.38.D05.1.454.CMB.2.raw
  modified_base (297)..(297): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtattttagtttgtctctggtaccaacacacccggcaacgccccaaatatcatttanaggacactaagcgccctggggtttcaacgtcgcttctctggcctccaagtccctaggctaaacgccggtccctcccgtgacctaagttctacgtggggccttcgagggcctacgagggtacgaacgggcttaggaactttatttccgtgttcgtcttaccgtagttagtgaccgtaacggggaccctaaggtccgtaacgtttgggggtacggttcggggacgggtaaggggacccgtaggggtttaccggacccggttaccgtacgggtccgtaaccggaccccgaaagggtccccgtacccggtccccccggtgggttaaccctacccggttcccttccggttccccctacccttcccgtaccttcccgg

SEQ ID NO: 435634 - DNA, 690 bp, Homo sapiens
  misc_feature: GZ8MTXP02H75DF.45.38.D05.1.454.CMB.2.raw
  modified_base (158)..(158): a, c, t, g, unknown or other
  modified_base (509)..(509): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggcccttttcngccctgactcagcctgcctcgtgtctgggtctcctggacagtcatcaccatggcctgcacgtaggaaaccaagagtgagttggttgggtattttagttttgctccgtaggtaaccaaaccaaaccgaccccggacgaaaccgacccccaaaataaactctaaattttaagaacgggaactaacgtaaaggccggtacccgttcgggggtttacaaaggttcgtctttcgcgtcggcctaccgaaagttccctagggaacaacgaccggtccttacccgagactaaagttctcgttcggggacctccgaagtccacgaagggacgaggtctagattttactttcgtgtttcnctatatagtcgacgtaacggtacagtcgtaggttgggtcggtacgggacgggtaacggtaccgtaggttaccgaccgttcgacggtacaaccgacccggtaacggtcccgtacccggtaccccgtcggtaaccctaccgttccgttaccccgttaccccctacccgttccgttaccgtccg

SEQ ID NO: 435635 - DNA, 666 bp, Homo sapiens
  misc_feature: GZ8MTXP02H2WBP.45.38.D05.1.454.CMB.2.raw
  modified_base (427)..(427): a, c, t, g, unknown or other
  modified_base (446)..(446): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtttcctggacagtcgatcaccatggcctgcactaggaaaccaacgagtgtagttggttagggttagtttttagtttgtctccgtacggtaccaacaaccaccccggcaaccgacccccaaataatactatttaagaggacactaacggcggacccgttggggttacaacgtcgcttctctggctcaagtctcgacacgacgtcctccagacactctcgtcggctccgaggctcgagacgngctgtattgtttctgttcnctcatatcgacgtagggacctagtaccgttacggtttggggtacggttaccggggacgggtacggggtaccgttaaggggttaccggtaacccgttacccggttacgggtacccgtaaccggaacccgtaaccgggcccgttccccgccccccggttacggtcccttaaccgtcccgttacccggttcccccgtccttaccccgtccgttacggtcccgg

SEQ ID NO: 435636 - DNA, 547 bp, Homo sapiens
  misc_feature: GZ8MTXP02HGOMJ.45.38.D05.1.454.CMB.2.raw
  modified_base (269)..(269): a, c, t, g, unknown or other
  modified_base (429)..(429): a, c, t, g, unknown or other
  modified_base (434)..(434): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctgggtccnccagcccccagggaagggctggagtggattgggactgtctactctagtgggaccactattacagcccgtcctcaagacctcgactggtgatctcataaacacgtaccaagaaccaatctccctgagctgaactctgtgacccgcgcgacacggccaaatnttacngtagcaagagaggcctaggaattatctttagaccacgtcggggcctgggaaccctggtaccaccggtctcccgtcaacgccctaccgaccaacgggccccagtccggttcccc

SEQ ID NO: 435637 - DNA, 670 bp, Homo sapiens
  misc_feature: GZ8MTXP02HXVI6.45.38.D05.1.454.CMB.2.raw
  modified_base (307)..(307): a, c, t, g, unknown or other
  modified_base (349)..(349): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcatcaccatggcctgcactggaaccaacagtgattggttgggtatttttagtttgtctcctggtaccaacaacaccccggcgaaccgccccaaataactcaatttanaaggacactaagccggcccgtcggggtttcaagtcgcttctntggtctccaagtccctggacaaccgacggtccctccccgtagacctaacttcctcgttcggggcccttccggacggcctacgacgggacccgaagggtccttaggaattttagtttctgtttcgccttcaatagttcgacgacgggtaccaggtaccgtacggtttggggtacggttcgggcgggtaacggggtacccgtagggtttcggaacccgttcgtaacggttccgaacggacccgtaacggcccgtccggtccccccgttcggtcctaacccgtttccgtcccggttccccctcccccgttcctcccgttcccgg

SEQ ID NO: 435638 - DNA, 673 bp, Homo sapiens
  misc_feature: GZ8MTXP02JK2Q6.45.38.D05.1.454.CMB.2.raw
  modified_base (230)..(230): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaattttggggctggtccgccagcccccgagggaagggctggagtggattgggactggtctactctagtcgggacctacgtattacacgcccgtccctcaagccctcgactggtgatctcaactaaacacgtaccaaacgaaacctaaacttcctaccctagacggtactaggaaacctcgtagtacgaaccccggcccggaccggggaaccaccgggaaccctaaaaacgttacttaaaccgtaggttacgaccaaaacgggaaggacggggtacccttagggtaaactttacgttacccgttttaggaaccccgtaacgtcgggggtacccgtacgggtaaccccgtaggtcccgtaacccgtccttacccgcaacggtccctacccgaaccgaacgggcccctacggtccggttcccccg

SEQ ID NO: 435639 - DNA, 589 bp, Homo sapiens
  misc_feature: GZ8MTXP02HTOPR.45.38.D05.1.454.CMB.2.raw
  modified_base (228)..(228): a, c, t, g, unknown or other
  modified_base (299)..(299): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttgggtatttttagtttgtctctgtaccaacaacacccggcgaacgccccaaatatcaatttanaggacactaagcggccctggggttcaagtcgcttctctgctcaagtcctaggccaacaccggcctaccctagacctaatctacgtcgggcctccgaggctcgaaggacgaggctagtatttatttctgtttcgctacgatatgcagggtaccagctacgttgggtacgttcgggacggtagggacccgtagggtcgacccggttcgtaggtccacgaccgtaaacggcctaccgtcccccgtaggtccaccgttccgttcccggttccccgtccccttccttaccgtccg

SEQ ID NO: 435640 - DNA, 596 bp, Homo sapiens
  misc_feature: GZ8MTXP02FRQGZ.45.38.D05.1.454.CMB.2.raw
  modified_base (346)..(346): a, c, t, g, unknown or other
  modified_base (425)..(425): a, c, t, g, unknown or other
tcagacgcgatcgacacgaccggtgctcgatttagtatctgatagttgggtttggggacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaattaaatttggggctgggtccgccacgcccccgagggaaggggctggagtggatgggactgtctactctagtggaccactataccagccccgtcctcaacgactcgactggtnatctacaactaaacacgtacaagaaccaattctccctgagctgaactctgtcgaccgccgcgacacgccaaatactacngtgacaaagagagggccaggtaattatccttgaccacgtggggacctacgggaacctggacctaccgtctaccttccgaacgccctaccgaacccgaacgggcccctacgttacccggtccctttcccccccgaggtacccccaccccgtaccctacccgaaacggacccg

SEQ ID NO: 435641 - DNA, 620 bp, Homo sapiens
  misc_feature: GZ8MTXP02FMN42.45.38.D05.1.454.CMB.2.raw
  modified_base (229)..(229): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatggttgggtatttttagtttgtctcctggtaccaacaacaccccggcgaacgacccccaaataactctaatttagaggacaactaaggccggccccgtggggtttacagtcgtcttctctggctcaagtcctggacaacacggccctccctagaccaatctctcgggcctcgaggctcgaggacgaggctagtatttacttcttgttgctacattagtgcgaacgggacctaggctacgtttggggtcggttcggggtacgggtacggggtaaccggtacgggttacggtacccgttaccgtacggttaccgacggtcccgaacggtcccgtccgcccccgttcggtcctaccgtcgttccgtcccccgtccctccgtaccttccg

SEQ ID NO: 435642 - DNA, 659 bp, Homo sapiens
  misc_feature: GZ8MTXP02HZW5O.45.38.D05.1.454.CMB.2.raw
tcagacgcgatcgacacgaccggtgctcgatttagtatctgatagttgagtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgccacgtaggaaaccaacagtgagttggttagggtagtttttagttttgtcttcctaggtaaccaacaaccaccccggacgaacgacccccaaaactaatactaatttaatacgggaacacgtaaacggccggtcccgtttacgggggtttacaacggttcgtcttcgtcgtcggcctacctaagtcgtcggacaaccgaccggtccctccctgaacctaactccgtcgtcgggcctaccgacggcctcgaggacgaggtctgttatttactttcgtgttcgcttactattacgtgacgtaaggggacccaggtacgtacggttggggtacgttcgggacgggacgggtaccgtagggttcgaccggttcgtacggtaccacgacccgtagccctccggccccctggtaccctaccgtccgtcccgttacccctaccgttccctcg

SEQ ID NO: 435643 - DNA, 571 bp, Homo sapiens
  misc_feature: GZ8MTXP02FSC6G.45.38.D05.1.454.CMB.2.raw
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttggggatttttagtttgtctcctggtaccaacaacaccccggcgaaacgcccccaaaactaatcaatttatagggacactaaagcggccctcgggggtttcaagtcgcttctctgctccaagtcctgcaacacgcctccctgacaatctctggctccaggctcgaggacgagctgattattctgttgctcattagtgacgacggacagtacgtacgttgggtcgtcgggacggacggtacgtaggttcgacgtacgtaggtcgacgaccgaacggtccgtccgtccccgtcgtccgtaccgttccgttccgttcccctacccgttccgtacgtcg

SEQ ID NO: 435644 - DNA, 577 bp, Homo sapiens
  misc_feature: GZ8MTXP02FJOQR.45.38.D05.1.454.CMB.2.raw
  modified_base (380)..(380): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtagttttagttgtctctggtaccaacaacacccggcgaacgccccaaactaatcatttataggacactaagcggcccgtcggggtttcaagtcgcttctctgctccaagtcctggcaacacggcctccctgacaatctcngggcctcgaggctcgaggacgaggctgatttattctgttgctacatatgcgagggaccagctacgttggggtgttcgggcgggtacgggaccgagggttcgaccgtcgtacggtcacggcccgaacggtccgtccgcccccgttcggtaacctaccgttccgttccggttcccccgtccccttcccgtccttacccg

SEQ ID NO: 435645 - DNA, 590 bp, Homo sapiens
  misc_feature: GZ8MTXP02GHTEA.45.38.D05.1.454.CMB.2.raw
  modified_base (525)..(525): a, c, t, g, unknown or other
tcagacgcgatcgacacgaccggtgctcgatttagtatctgatagttgggtttggggacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaattaaagttttggggctgggtccgccagcccccgagggagggctggagtggatgggactgtctactctagtgggaccacctattacacgccccgtaccctcaacgacctcgacgttggtgatctacaactaaacaccgtaccaaagaaccaattcctccctgacggctagaactctgtcgacccgcgacggacacggacaaatatactgtgacaagagacggcctaggtaacttctacctttagacctacgtcggggcctacgggaaccctggtaccacccgtctcctcacnccctaccaccgacggcccagttcccggtaaccttcccccgcgcccacccgtcctaccaacgaccg

SEQ ID NO: 435646 - DNA, 545 bp, Homo sapiens
  misc_feature: GZ8MTXP02JIG0U.45.38.D05.1.454.CMB.2.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctggtccgccagcccccagggaagggctgggagtggatttgggactgtctactctagtggggaccaccctattacagcccgtccctcaagaccctcgactggtgatctcataaacacgtccaaagaccaattctccctgagctgaactctgtgacccgccgcggacacggccaaatattactagtgacaagagagggcctaggaattatcctttgaccactcggggcctggggaaccctggtccaccgtctcctcaagccctaccaccgaaggcccatcggtccc

SEQ ID NO: 435647 - DNA, 731 bp, Homo sapiens
  misc_feature: GZ8MTXP02HAJLG.45.38.D05.1.454.CMB.2.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcggtgggccctttctgccctgactcagcctgcctcgtgtctgggtctcctggacagtcgatcaccatcggcctgcactaggaaccaacagtgattggttgggtatttttagtttgtctcgtaggtaaccaacaaccgacccggacgaaaccgaccccctaaaactaactactaatttaagtaacgggaactaacgtaacggccggtcccgttcggggtttacaacggtcgtctttctcgtggcctacgaacgtccgtacggaccaaccgaccggtccctacccgtagacctaactcgtcgtcgggtcctccgacggtcctacgacggaacgacggtcgtagttagtttactttcgttcgttcgtcttactaagttagtcggacgaacggggtaccaggtaccgttacgggtttcggggttcgggttcggggacggggtaacggggtaccggttacgggttccggtacccggttacggtacggtaccgaccggacccggaacggtcccgtaccccggtcccccgttacgggtcccgtacccgttccgttccccggttacccccggtccccttacccgttacccgtccgg

SEQ ID NO: 435648 - DNA, 588 bp, Homo sapiens
  misc_feature: GZ8MTXP02HNLHT.45.38.D05.1.454.CMB.2.raw
  modified_base (227)..(227): a, c, t, g, unknown or other
  modified_base (305)..(305): a, c, t, g, unknown or other
  modified_base (383)..(383): a, c, t, g, unknown or other
  modified_base (435)..(435): a, c, t, g, unknown or other
  modified_base (446)..(446): a, c, t, g, unknown or other
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttgggattttagtttgtctcctggtaccaaacaacaccccggcgaaacgcccccaaactaaatcaatttanagggacactaaagcggccctcgggggtttcaagtcgctttctctggctccaagtccctggacaacgacggccttcccngaccaatctcgtgggcctcgaggtctacaggacgaggctagtatttatttcnggtttcgctanatatgacgacggacgacgacgtacgttggtcggtcgggtacgggacgggacggtacggtacggtaccgtaccgtacggtacgacgaccgacgacgtccgtcccgtccgtccgtacgtccgtccgtccctaccctcctcctcg

SEQ ID NO: 435649 - DNA, 651 bp, Homo sapiens
  misc_feature: GZ8MTXP02IRJQB.45.38.D05.1.454.CMB.2.raw
  modified_base (230)..(230): a, c, t, g, unknown or other
  modified_base (371)..(371): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataagtttggggctggtccgccacgcccccgagggaagggctggagtggagttggacgtgtctactcgtagtggaccactattacacgcccgtcctacgaacgaccctcgactggtgatctanactaaacacgtaccaaagaaccaatcctccctagacgctagaactctgtcgaccgccgacggacacgactaaatacttacgtacgtgacgaaggacggacgggtcctagggtaaactttacgttaccctttacggaaaccgtaacggtcgggggtaccccgttacgggggaaacccccttcggtacccgtaccccgtttaccgtccccttaccgaacccgtccccgtacccgaaccccggaaaccggcccccgtaaaggtttcccccgggtttacccccg

SEQ ID NO: 435650 - DNA, 707 bp, Homo sapiens
  misc_feature: GZ8MTXP02GS0GJ.45.38.D05.1.454.CMB.2.raw
  modified_base (229)..(229): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgagttggttgggtattttagtttgtctcctggtaccaacaacacccggcgaacgccccaaatatctatttagacggacacgtaacgcggtcccgtcggggtttacaacgtcgtcttcgtctggcctccgtaagtccgtcgggacctaaaccgaccggtccctacccgtagacctaacttccgtcgtcggggccttacccgagggtccttacggaacgggaccggaggtcctagttaagttttacttttccgtggtttacgtccttacgtagttaagttcgggacgaacgggggacccctaggtaccgttaccggtttgggggttccggtttaccgggggacggggtaacgggtaccgttaggggttaccgacccggttacgtcgggtaccgacggtacccgacggtcccgtacccggcccccgttacggtccctaccgtcccgttcccgtccccctacccgttccgtacctccgg

SEQ ID NO: 435651 - DNA, 602 bp, Homo sapiens
  misc_feature: GZ8MTXP02HM4WD.45.38.D05.1.454.CMB.2.raw
  modified_base (234)..(234): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaacgccttcggacgaccctgtccctcacttgctagtgtctcgtggtnactccatcagttagtagtcaataaatttggggctgggtccgccacgcccccgagggaacggggctggagtggatgggactgtactctctaggtcgggaccactattacgacgcccgtccctacaacgcctcgactggtgactctacaataaaccacgtaccaaacgaacctaacttctaccctgacgtctagtaactcgtcgacgaccgccgcggaacaccgacaaatattacgtagttgacaaggagacggtacctaggaactttctaccgtttagacctaacggtcggggacctacgggtaaccctggtaccaccgtcctcctacaaccgtcccaccgacgaccggccctagtcccggtttccccg

SEQ ID NO: 435652 - DNA, 605 bp, Homo sapiens
  misc_feature: GZ8MTXP02GXPH0.45.38.D05.1.454.CMB.2.raw
  modified_base (227)..(227): a, c, t, g, unknown or other
  modified_base (274)..(274): a, c, t, g, unknown or other
  modified_base (278)..(278): a, c, t, g, unknown or other
  modified_base (295)..(295): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctctggacagtcgatcacatggcctgcactggaaccaanagtgatggttgggtattttagtttgtctctgtaccaacacacccggnaacnccccaaatatcatttanaggacactaagcgccgtggggttcaagtcgcttctctgctaccaagtcctggacaacgacggtcctacccgtgacctaatctacgtcgggcctcgacggtctacgaaggaccgaggctagtatttattcgtgttcgctacattactgacgacgggaccagcgtacgttgggtcggtcgggacggacgggtaccgtagggttcgaaccgttcgtacggtcgaacggcccgaaacggtccgtcccgcccccgttcggtaaccctaaccgttccgttacccggttccccctaacccgttccctccgtacccgg

SEQ ID NO: 435653 - DNA, 592 bp, Homo sapiens
  misc_feature: GZ8MTXP02JL6JS.45.38.D05.1.454.CMB.2.raw
  modified_base (230)..(230): a, c, t, g, unknown or other
  modified_base (314)..(314): a, c, t, g, unknown or other
  modified_base (453)..(453): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcacggatgcgtcctgtcccagctgcacctgcaggagtcgggcccaggactggtgaagccttcggagaccctgtccctcacttgcagtgtctctggtnactccatcagtagtagtcattaaatttgggctgggtccgccacgcccccgagggaagggctggagtggatgggactgtctactntagtcggaccactattacagcccgtcctcaacgactcgactggtgatctcaaactaaacacgtaccaaagaacctaaattcctccctagacggtctagaactcgtagtcgaccgcgacgacacggaccaaatacttacngtagacaagagacgggacctaggaacttacgtcctttagacctacggtcggggacctacggggtaaaccctcgggtacctacccggtctccctaacgacgtaccctccgaaccgaccgggtccccaagtttcccccggg

SEQ ID NO: 435654 - DNA, 663 bp, Homo sapiens
  misc_feature: GZ8MTXP02G2AX1.45.38.D05.1.454.CMB.2.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtctattaaagtttggggctcgggtccgccacgcccccgaggggaacgggcgtggagtggagttgggactgtctactcgtagtcgggacctacctattacacgcccgtccctacgacgaccctcgactggtgactctacaataaaccacgtaccaaacgtaaaccctaacttcctaccctagacggtctagaaactcgtgtacgacccgccggacggaccacggactaaatcttaactgtagacgtaagacgacgggtccgtaggtaattacgttaccgtttacgaccgtacggtacggggtacccgttacgggtaaaccccgtcggttacccgacccgttccctaccgtaccgaacccggtcccctaaccccgtaaccggaaacccggtcccctaaccggttcccggtttccccccg

SEQ ID NO: 435655 - DNA, 604 bp, Homo sapiens
  misc_feature: GZ8MTXP02JY27E.45.38.D05.1.454.CMB.2.raw
  modified_base (342)..(342): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagttttagtttgtctcctggtaccaacaaccacccggcaacgacccccaaataatcatttataggacactaagcggcccgtggggtttcagtcgcttcnctgctcagtcctggcacacgcctcctgcatctctgggctcgagctcgaggacgaggctgtatttatttctgttcgctacattacgtgacgagggaccagaccgtacgtttgggtacgttccggggcgggtacgggtacccgtagggttccggaacccggttccgtaacgggtccacggtacccgaacgggtccgtcccggccccccgttggtcccaccgtttccgtcccggtttcccccacccgtttcccgtccgttaccgg

SEQ ID NO: 435656 - DNA, 570 bp, Homo sapiens
  misc_feature: GZ8MTXP02GNTRG.45.38.D05.1.454.CMB.2.raw
  modified_base (364)..(364): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctgggtccgccagcccccgagggaagggctggagtggattgggactggtctactctagtgggaccaccgtattacagcccgtccctcaagaccctcgactggtnatctcataaacacgtaccaaagaaccaatctccctgagctgaactctagtgaccgccgcggacacggaccaaagtattactgtagacaaggagaggacctggaattactcctttgaccctacgtcggggcctgggtaaccctggtccacccgtctccctcgaacgccctccgaacccgaacgggcccctacgttccggttcccccg

SEQ ID NO: 435657 - DNA, 587 bp, Homo sapiens
  misc_feature: GZ8MTXP02HMYP6.45.38.D05.1.454.CMB.2.raw
  modified_base (230)..(230): a, c, t, g, unknown or other
  modified_base (301)..(301): a, c, t, g, unknown or other
tcagacgcgatcgacacgaccggtgctcgatttagtatctgatagttgggtttgggggggtcacaagaggcagctctctcgggacgtctccaccatggcctgggctctgctgctcctcactctcctcactcaggacacaggatcgtgggccctttctgccctgactcagcctgccctccgtgtctgggtctcctggacagtcgatcaccatggcctgcactggaaccaanagtgatgttgggtatttttagtttgtctctgtaccaacaacacccggcgaacgccccaaataatcatttanaggacactaagcggccgtcggggttcaagtcgcttctctgctcagtcctgcaacacggcctccctgaccaatctcgtgggcctccgagcctcgacggacgagctgtatttatttctgttgctcatagtgcgagggacagctacgttggggtcgttcgggcgggtacgggaccgtagggttcgacccggttcgtacgggtcaacggtacccgaaacgggtcctccggtcccccgtcgggtccctacgttcccgttccggttcccccgtccccttccgtaccgtccgg

SEQ ID NO: 435658 - DNA, 587 bp, Homo sapiens
  misc_feature: GZ8MTXP02GZJIJ.45.38.D05.1.454.CMB.2.raw
tcagacgcgatcgacacgaccggtgctcgatttagtatctgatagttgagtttgggggtcacaagaggcagcgctctcgggacgtctccaccatggcctgggctctgctgctcctcactctcctcactcaggacacaggatcgtgggccctttctgccctgactcagcctgcctccgtgtctggtctccgtggacagtcgatcaccatcggcctgcactaggaaaccaacagtgagttggttggttagttttagtttgtctctagtaccaacaaccacccggacgaacgaccccaaatactctaattagaggacacgtaacgccggtccgttcggggttacaacgtcgtcttctcgtcgtctacaacgtctagacaacgcggcctccgtgacatctcgtcggctcgagctcgaggacgagctagtactttactttcgtgttcgcttacgtaattagtcgacgacgggaccagtcgtaacggttgggtacggttcggacgggacggacgtaggtcgtaccgtcgtacggtcgacgaccgacgccgtaccgcccgtcggacctaccgtctccgtccccgccttcctccg

SEQ ID NO: 435659 - DNA, 550 bp, Homo sapiens
  misc_feature: GZ8MTXP02JV1DU.45.38.D05.1.454.CMB.2.raw
  modified_base (339)..(339): a, c, t, g, unknown or other
  modified_base (415)..(415): a, c, t, g, unknown or other
  modified_base (422)..(422): a, c, t, g, unknown or other
  modified_base (489)..(489): a, c, t, g, unknown or other
  modified_base (529)..(529): a, c, t, g, unknown or other
tcagacgcgatcgacacgaccggtgctcgatttagtatctgatagttgggtttggggacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttgggctggtccgcagcccccagggaaggagctggagtggattgggactgtctactctagtgggaccactattacagcccgtcctcaagactcgactggtnagtctaccaataacacgtaccaagaaccaattctccctgacgctgaactctgtgaccgcgcggacacggccaaatntactgtncaagagaggcctggaattactccgtttagacctacgtggggcctcgggaccctggtccacgtctccncacgcctaccgaccacgggcccagtccgtaccttccccgnggcccaccctcctaccaacgg

SEQ ID NO: 435660 - DNA, 638 bp, Homo sapiens
  misc_feature: GZ8MTXP02JP76Z.45.38.D05.1.454.CMB.2.raw
  modified_base (426)..(426): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagttttagtttgtctctggtaccaacaaccacccggcaacgcccccaaatatcatttagaggacactaagccggccgtcggggttcagtcgcttctctcgctccagtcctggacacgaccggcctccctgaccatctcgtggcctccgagtcctacgaggaccgtaggcctggtaactttttntttcgtgttcgtctatattagtcgacgacgggaccagtccgttaggttcggggtggttaccggggacgggtaacgggtaccgttagggtaccgacccgttcggtacggtccgaaccgggtacccgaacggtcccgtcccccggtcccccgttacggtccctacccgttcccgtttaccccgtaccccctccccgtttccgtacccgttaccg

SEQ ID NO: 435661 - DNA, 571 bp, Homo sapiens
  misc_feature: GZ8MTXP02JK4K6.45.38.D05.1.454.CMB.2.raw
  modified_base (339)..(339): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctggtccgcagccccgagggaagggctggagtggagttgggactgtctactctagtggaccactattacagcccgtccncaacgacctcgactggtcgatctacataaacacgtaccaaagaaccaattctccctagagctagaactctgtagacccgccgacgacacggaccaaatacttactgtagcaaaggagagggcctagggtaattactcctttagacctacgtcgggggccttacggggaaaccctggtaccaccgtcctccctcgaacgtccctaccaccgaacggcccacgtccggttcccc

SEQ ID NO: 435662 - DNA, 674 bp, Homo sapiens
  misc_feature: GZ8MTXP02IVIHI.45.38.D05.1.454.CMB.2.raw
  modified_base (252)..(252): a, c, t, g, unknown or other
  modified_base (304)..(304): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctcctgtctgggtctcctggacagtcgatcaccactcccctgcactggactccagcggtgacgttacttagttttaantgtctcctgtatcagacaacaccaggacaaacgccccaactcatctatttangatgtacaataatccggtcctcgtagggtttctctactcccgtcttcctcgtcgtctacctaagttccgtacggactaaacgttacccgtccccctacccgtacgtaccctacttccgttccgtcggggtccctaccgtacgggtacgttacggaaacggaacggacgggtacgttaaggttaatttaacgtttaaccgtgtaccgatactaactaattattaacgtttagttccgtttaccgtacggttacgggttacggtttacggggacggtaagggtaccgttaaggttaccggtaccgttaccgtaacggttaccgaaccgtaccgaacggtacccgtccgtacccccgttcggtacttaccccg

SEQ ID NO: 435663 - DNA, 642 bp, Homo sapiens
  misc_feature: GZ8MTXP02GX0TL.45.38.D05.1.454.CMB.2.raw
  modified_base (230)..(230): a, c, t, g, unknown or other
  modified_base (367)..(367): a, c, t, g, unknown or other
  modified_base (376)..(376): a, c, t, g, unknown or other
  modified_base (409)..(409): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactaggaaccaanagtgagtggttgggtagttttagtttgtctctgtaccaacaacacccggcgaacgcccccaaataatcaatttatagggacactaagcggtcccgtcggggttacaaggtcgtcttctctggctcagtcctgacacncggcctccngactatctcgtaggcctcgaggctcgaggacgngctggatttattctgttgctatacgtatcgacgacgggtaccacggtacgtaccggttgggtacggttccggggacgggtaacggggtacccgtaaggggttccgtaacccggttccgtaacgggttccgaaccggtccccggaaacgggtccctcccggtccccccgttcggtaaccctacccggttccttccccggttccccggtccccctttcccgtaccgtttccccgg

SEQ ID NO: 435664 - DNA, 615 bp, Homo sapiens
  misc_feature: GZ8MTXP02FQBV0.45.38.D05.1.454.CMB.2.raw
  modified_base (231)..(231): a, c, t, g, unknown or other
  modified_base (312)..(312): a, c, t, g, unknown or other
  modified_base (370)..(370): a, c, t, g, unknown or other
  modified_base (423)..(423): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatcggcctgcactacggaaccaanagtgattggttgggtagtttttagtttgtctcctggtaccaacaaccgacccggacgaacgacccccaaatatctatttanaggacacgtaagccggtcccgtcggggtttcaagtcgtcttctcgtcgctacagtccngacaacacgcctcctgacactctcgcgctcgagctcgacggcgagctgatttnttctgttcgctacattagtcgacgaacgggaccagtccgtaacggtttggggttcgttcggggcgggtaacgggacctaggggtttacgaccggttaccgtagggtaccacgacccggaacggtcccgtccgcccccgttacggtcctaccgtttccgttccccggttccccgtccccttccttaccgtccg

SEQ ID NO: 435665 - DNA, 574 bp, Homo sapiens
  misc_feature: GZ8MTXP02F0VUP.45.38.D05.1.454.CMB.2.raw
  modified_base (306)..(306): a, c, t, g, unknown or other
  modified_base (432)..(432): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagtttttagtttgtctcctggtaccaacaacaccccggcaacgcccccaaataatcaatttanaggacactaagcggccctcggggtttcagtcgcttctctggctcaagtcctggccaacacggccctccctgacaatctcgtgggcctccgaggctcgaggacgaggctgtatttattctgttgctnatatgacagggaccagctacgttgggtgttcgggcggagggacgtagggtcgaccgtcgtacggtcacggacccaaggccgtccgcccccgttcggtcctaccgttccttccggttcccccgtcccgtccgttccgtaccgg

SEQ ID NO: 435666 - DNA, 653 bp, Homo sapiens
  misc_feature: GZ8MTXP02FVP9Z.45.38.D05.1.454.CMB.2.raw
  modified_base (231)..(231): a, c, t, g, unknown or other
  modified_base (452)..(452): a, c, t, g, unknown or other
  modified_base (487)..(487): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatggcctgcactaggaaccaanagtgattggttaggggttatttttagtttgtcttcgtacggtaaccaacaaccgaccccggacgaaccgacccccaaatactctaatttaagtaggacaacgtaacggccggtcccgttcggggtttacacgtcgtcttcgtctggcctacgagtcctaggcaacgacggccctaccctgactactcgtacgtcgggcctcgagggcctacgaggaacggnggtacttaggtatttagttcgtttagtcgtcctanagttacgtgacgtacgggacctaggcgttacggttggggtacggttcgggcgggaacggtcgtagggtcgtaccgtcgtaacggtccgaacgtcccggaagtcccgtacccggccccgttggtaacctaccttccggttccctacccctacccgttcctcggtccg

SEQ ID NO: 435667 - DNA, 602 bp, Homo sapiens
  misc_feature: GZ8MTXP02H3NSO.45.38.D05.1.454.CMB.2.raw
  modified_base (232)..(232): a, c, t, g, unknown or other
  modified_base (360)..(360): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcgggagacccctgtccctcacttgcagtgtctctggtnactccatcagtagtagtcataaagtttggggctgggtccgcacgcccccgagggaagggctggagtggatgggactgtctactctagtggaccactattacagcccgtcctcaagaccctcgactggnatctacaataaaacacgtaccaaagaaaccaattcctcccagacggctagaactcgtagcgacccgcgacggaacacggtaaccaaaatattaactgtgacaaggagtagggcctaggaacttactcctttgaacctaacgtcggggacccttcggggaaaccccttgggtaccaacccgtcttcccgtacaacggtcccacccgaaacccgaaacgggccccaacgttcccgggttccccc

SEQ ID NO: 435668 - DNA, 634 bp, Homo sapiens
  misc_feature: GZ8MTXP02I7D3U.45.38.D05.1.454.CMB.2.raw
  modified_base (228)..(228): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcatcaccatggcctgcactggaaccaanagtgattggttgggtagttttagtttgtctctggtaccaacaaccaccccggcgaacgacccccaaactaatctaatttataggacactaagccggacccgtcggggtttcaagtcgcttctctggctccaagtcctaggccaacgaccgccctacccgtgaccaatcctcgtcgggcctccgaggtcctacgacggtaccgaggtctaggtatttagttcgtgttcgactctatagtgacggtacggacagcgtacgtttgggtcggttacgggcgggtaacggggacccgtagggtttacggaccccggttcgtacggtaccacggacccgaaaggtcccgtccgacccccgttggtaaccaccgttaccgtcccgttaccccctacccgtcccttcgtacccg

SEQ ID NO: 435669 - DNA, 575 bp, Homo sapiens
  misc_feature: GZ8MTXP02HCKTB.45.38.D05.1.454.CMB.2.raw
  modified_base (297)..(297): a, c, t, g, unknown or other
  modified_base (358)..(358): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtagttttagtttgtctctgtaccaacacacccggcaacgccccaaatatcatttanaggacactagccgccgtggggttcagtcgcttctctgctcaagtcctgcacacggcctccngcatctcgtggcctccaggctcgaggacgagctagatttattctgttgctcatatcgcagggacagcgtacgttgggtggttcgggcgggtacgggaccgtagggttcgacccgttaccgtacgggtcaccggtacccgaaacgggtccgtaccggtccccccgtcggtcctaccgttcccgttcccggtttacccccgccccttccgtccgtaccg

SEQ ID NO: 435670 - DNA, 568 bp, Homo sapiens
  misc_feature: GZ8MTXP02FGYT2.45.38.D05.1.454.CMB.2.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggatttttagttgtctctggtaccaacaacaccccggcgaacgcccccaaataatcatttataggacactaagcggccctcggggtttcaagtcgctcgtctggctccaagtcctggcaacaccggcctcccgtgaccaaatcctactcgggcctccgaggctcgaaggaccgaggctaggatttatcttgtgcttacatatgcgacgggaccagccgtacgttggggtcgttcgggcgggagggaccagggtttcgaacccgtcgtaggtccacgcccaaacggctcgccccctcggtcacgtcctcgtccccgtcctccgtctccg

SEQ ID NO: 435671 - DNA, 583 bp, Homo sapiens
  misc_feature: GZ8MTXP02I1Q7N.45.38.D05.1.454.CMB.2.raw
  modified_base (228)..(228): a, c, t, g, unknown or other
  modified_base (304)..(304): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccanagtgatgttgggtattttagtttgtctcctggtaccaacaacaccccggcgaacgcccccaaactaatcaatttanagggacactaagccggccgtcggggtttcaagtcgcttctctgctcagtcctggacaacaccggcctcccgtgacctatcctcgtcgggctcccgaggctccgaggacgaggtctgtatttactttctagtttgcttcattatgacgacgggaccaggctacgttgggtacgttcgggcgggacggtccgagggttcgaaccgttcgtaggtcacgtacccgaggtcctccgtccccgtcgtccgacgttccgtcccgttccccacccttcctcgtccg

SEQ ID NO: 435672 - DNA, 646 bp, Homo sapiens
  misc_feature: GZ8MTXP02F0QSX.45.38.D05.1.454.CMB.2.raw
  modified_base (483)..(483): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatggcctgcactggaaccaacagtgatggttgggtagtttttagtttgtctcgtagtaccaacaaccaccccggcgaaccgacccccaaatatactaatttagaacggacacgtaacggccggtccccgttagggggtttcaacggtccgtcttcgttcgtcgtcctaccgtaagtcccgtacggacctaaccgaccggtccctacccgtagacctaatccgtcgtcgggcctcgacgtctacgacggacgaggtctagttattagtttctgttcnctcatagtcgacgtacgggacagtctacggttgggtcgttcgggcggtacgggacgtagggtcgtaccgtccgtaggcctacggacccgaacggtcccgtccggtccccgttcggtcctacccgttccgttaccccgttcccctacccttcccgtccgtaccg

SEQ ID NO: 435673 - DNA, 568 bp, Homo sapiens
  misc_feature: GZ8MTXP02HG9UF.45.38.D05.1.454.CMB.2.raw
  modified_base (231)..(231): a, c, t, g, unknown or other
  modified_base (286)..(286): a, c, t, g, unknown or other
  modified_base (307)..(307): a, c, t, g, unknown or other
  modified_base (342)..(342): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcggtgggccctttctgccctgactcagcctgcctccgtgtctgggtctcctggacagtcgatcaccatggcctgcataggaaaccaanagtgattggttagggtatttttagtttgctctgtaaccaaacaaccaccccgganaacgaccccaaatatcattanaggacataagcgccgtggggttacagtcgtcttcnctcgtctcaagtcccgtgaccaacgaccgtcctccctagacctagtctcgtcgggctaccgagtcacaggacgtaggctgatttatgtgtgtctctatatgagacggacgagacgagttggtggtcggtcggacgggaccgtagtacgacgtacgtacgacgacgaccgaacgcgccgtccccgtccggtccgtacctccgttccgtcccgtccctcccgtctccg

SEQ ID NO: 435674 - DNA, 554 bp, Homo sapiens
  misc_feature: GZ8MTXP02HW0FL.45.38.D05.1.454.CMB.2.raw
  modified_base (155)..(155): a, c, t, g, unknown or other
  modified_base (225)..(225): a, c, t, g, unknown or other
  modified_base (250)..(250): a, c, t, g, unknown or other
  modified_base (262)..(262): a, c, t, g, unknown or other
  modified_base (265)..(265): a, c, t, g, unknown or other
  modified_base (275)..(275): a, c, t, g, unknown or other
  modified_base (280)..(280): a, c, t, g, unknown or other
  modified_base (353)..(353): a, c, t, g, unknown or other
  modified_base (372)..(372): a, c, t, g, unknown or other
tcagacgcgatcgacacgaccggtgctcgatttagtatctgatagttgagtttgggggtcacaagaggcagcgctctcgggacgtctccaccatggcctgggctctgctgctcctcactctcctcactcaggacacaggatcgtgggccctttcngccctgactcagcctgcctcgtgtctgggtctcctggacagtcgatcaccatggcctgcactgaaccaangtgatgttggtattttagttgctcngacacacaccgnacncccaaatacnattanaggacactaagccgtaccgtggggttcagtcgtcttcgctggctccgaagtccgtgccaacgcggcccttacncgactaatctcgtggcccncgcgctacgaggacgacgtgtagtattatttcgttgttcgtctactatagtagacgacgacgacgtacgtacggttgggtacggtcgggtcggtacggtacggtacggtacggtacggtacgtacgtacgacgaccgacgtccgtccgtcccgtccgtcgtcgtctccgtccctcctcctcg

SEQ ID NO: 435675 - DNA, 624 bp, Homo sapiens
  misc_feature: GZ8MTXP02ITDIU.45.38.D05.1.454.CMB.2.raw
  modified_base (231)..(231): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtcccctcacttgcagtgtctctggtnactccatcagtagtagtcataaatttggggctgggtccgcagcccccagggaagggctggacgtggagttgggacttgtctactcgtagtgggaccacctattacacgcccgtccctcaagaccctcgactggtgatctcataaacacgtaccaagtaaccaagttctacccgtgaggtcctagaactctgtacgaccgcgcggacacggacctaaaatactaactgtagacaaggaacgacgggtcctaaggggtaattacgttaccgtttacgacccgacggttacgggggccctaggggaaacccccgttgggtacctaccccggttcgtccccttcgaacgccccttacccgaccgtaaccggggcccctaagtcccggtttacccccg

SEQ ID NO: 435676 - DNA, 609 bp, Homo sapiens
  misc_feature: GZ8MTXP02FJYOH.45.38.D05.1.454.CMB.2.raw
  modified_base (298)..(298): a, c, t, g, unknown or other
  modified_base (353)..(353): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccacagtgatggttgggtagttttagtttgtctctgtaccaacacacccggcgaacgccccaaatatctattanaggacactagcgccgtcggggttcaagtcgcttctctgctaccagtcctgcaacnccggcctcccgtgacactctcgtcgggctcgaggcctacgacggtacgaggctgtatttagttcgttgttcgacctatagtacgacgacggaacgcgtacgtacggttacggttcgggttccgggtcggggaacggggtacggtacgggttcggtaccgtacccggtacggtaccggtcgaccggtaccgtacggtcccgtccccgcccggtttcgcccgtacgttccgtccccggtcccctaccgtcctcgtacg

SEQ ID NO: 435677 - DNA, 695 bp, Homo sapiens
  misc_feature: GZ8MTXP02H8KUT.45.38.D05.1.454.CMB.2.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctggtctcctggacagtcgatcaccatggcctgcactaggaaccagagtgagttggttggtagttttagtttgtctcgtgtaaccaacaccgacccggacaaccgaccccaaataatactaagtttagtacggaacctacgtaacggcccggtacccggttcggggttacaacggtcgtacctttcgtcgtcggtcctaccgaagttcccgtacggacctaaccgccggtccctacccgtagacctaacgttccgtacgtacggggtccctacccggaggtcccgtacgagggacgtagtcgtagttaatttcgtttcgtggtttaccgacttagtaagtacgtacgacggtacggaccgtagtaccgttaggttgggtccggtacggggacgggtaacggtacgtacgggtaccgtaccgtacgtacgtacgaaccgtaccgtacggtcccgtccccgtcccgtacgtaaccgtccgtccgttccccgtccccgtaccctccgttaccgtcg

SEQ ID NO: 435678 - DNA, 604 bp, Homo sapiens
  misc_feature: GZ8MTXP02FL0Z9.45.38.D05.1.454.CMB.2.raw
  modified_base (344)..(344): a, c, t, g, unknown or other
  modified_base (428)..(428): a, c, t, g, unknown or other
  modified_base (434)..(434): a, c, t, g, unknown or other
  modified_base (511)..(511): a, c, t, g, unknown or other
tcagacgcgatcgacacgaccggtgctcgatttagtatctgatagttgggtttggggacggacctcctgtgcaggaaaatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcattaaagttttggggctgggtccgccacgccccgagggagggctggagtggattgggactgtctactctagtggaccactattacacgcccgtccacaagactcgactggtnatctacaaataaacccacgtaccaaagaacctaattcctccctgacgctagaactctgtcgaccgccgcgacacggaccaaatnttacgngagacgaagagacggtacgtagtaatttacgtcgttacgaccgtacggtcgggaccgtacgggacccgtcggtaccnccgtcctccacgaccgtacccaccgaaccgaccggccctacgtcccgttcccgtccccgtcgacccctacccgtaccgtaccgacgaccgccg

SEQ ID NO: 435679 - DNA, 640 bp, Homo sapiens
  misc_feature: GZ8MTXP02IA3P2.45.38.D05.1.454.CMB.2.raw
  modified_base (230)..(230): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtatagtcattaaatttggggctgggtccgcagcccccgaggaaggggctggagtggattgggactgtctactctagtgggaccaccgtattacacgcccgtccctcaagacctcgacctggtgatctcataaacacgtccaaagaaccaattctaccctgacggctagaactctgtacgacccgcgcggaccacgggaccaaaagtctttaactgtagacgaaagagagggccctagggtaaactttaactccgttttagaccccgtaacgtcgggggtacccgttacggggaaaccccttcggggtaccctacccgggttccttccccgttaccgaaccggtccccttaccccgaaccggtaaaaccggggccccctaacggtccccgggtttcccccg

SEQ ID NO: 435680 - DNA, 607 bp, Homo sapiens
  misc_feature: GZ8MTXP02IRCM0.45.38.D05.1.454.CMB.2.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactcatcagtagtagtcataaatttggggctgggtccgcagcccccagggaaggggctggagtggattgggactgtctactctagtcgggaccacctattacagcccgtccctcaagacctcgactggtgatctacataaacacgtaccaaagaaccctaaattcctaccctgacgctgaactctgtgacccgccgcggacaccggacaaagtacttactgtagacgaaggagacggggcctagggtaattagttcctttaggacctacgttcgggggtccgtacgggggaaacccgttcgggtcctaccggttccttcccgtctaacggccccttaccgacccgaaacggggcccctaacgtcccgggtttccccc

SEQ ID NO: 435681 - DNA, 683 bp, Homo sapiens
  misc_feature: GZ8MTXP02G0BXQ.45.38.D05.1.454.CMB.2.raw
  modified_base (229)..(229): a, c, t, g, unknown or other
  modified_base (277)..(277): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcacatcggcctgcactggaaccanagtgatggttgggtattttgttgtctcgtgtacacacgcccgacgacnccccaaatatctattagaggacactagccggtccctggggtttcaagtcgtcttctctggctaccagtcctagaccaacgccggcctccctagaccactctccgtggcctcgagtctcgaaggcgagctagtagtttatttcgtgttcgtctacgtattagcgacggtacggggaacccaggtacccgttacggttacgggggttggttccgggggaacggggtacggggtaaccgtaacgggggtttccgaaaaccccggttcggtaacccgggttaccggaaaccggttacccccggaaacgggtccccgttacccggtaccccccgtttccggggaacccttaacccgttcccggtttaccccggtccccccggttcccctttaccccgtcccggtttcccgg

SEQ ID NO: 435682 - DNA, 620 bp, Homo sapiens
  misc_feature: GZ8MTXP02JAOWE.45.38.D05.1.454.CMB.2.raw
  modified_base (157)..(157): a, c, t, g, unknown or other
  modified_base (453)..(453): a, c, t, g, unknown or other
  modified_base (477)..(477): a, c, t, g, unknown or other
  modified_base (481)..(481): a, c, t, g, unknown or other
  modified_base (491)..(491): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttntgccctgactcagcctgcctcgtgtctgggtctcctggacagtcgatcaccatcggcctgcactaggaaccaacagtgattggttgggttagttttagtttgtctcgtaggtaccaacaaccgaccccggacgaaccgacccccaaaatactactaacttttaagaacggacctaacgttaacggccggtacccgttcgggggtttacaacggtccgtctttctcgtggtcctacgaagtccgtcgaccaacaccggcctacctgaccatctcgtcgggctcgagctacgagacgngctagtattattcgtagtctctanatangacgaggacncgtacgtaggttgggcgtcggacggacggtacgttacggtaccgtacgtacgtacggtaccgacggaccgtacgtcccgtccgtaccccgtgtccgtcctccgttcccgtacccctcctccgtacgtcg

SEQ ID NO: 435683 - DNA, 545 bp, Homo sapiens
  misc_feature: GZ8MTXP02F00DV.45.38.D05.1.454.CMB.2.raw
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagtttgtctctggtaccaacaacacccggcaacgcccccaaactaatcatttatagggacactaagcgccctggggttcaagtcgctctctgctcaagtcctggcaacacggcctccctgcaatctctcggggctccaggctcgaggacgaggctgatttatttctgttgtcttcattatgcgtagggcagctacgttgggtgttcggcgggacgggacctagggtcgaccgtaccgtaggtcacggcccaaggccgtcgcccccgtcggcctacgtctcgttcccgcctcccgtctccg

SEQ ID NO: 435684 - DNA, 711 bp, Homo sapiens
  misc_feature: GZ8MTXP02GKFCK.45.38.D05.1.454.CMB.2.raw
  modified_base (229)..(229): a, c, t, g, unknown or other
  modified_base (426)..(426): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggccaggactggtgaagccttcggagaccctgtccctcacttgcagtgtctctggtnactccatcagtatagtcaataagtttgggctgggtccgcagccccgagggagggctggagtggagttggactgtctactcgtagtgggaccactattaccgacgtcccgtcctacaacgacctcgactggtgactctacaactaaacacgtaccaaagaaccaaacgtttcctaccctagacggtcctacgaaactntcgtcgaccggccgacgggaccaccgggacccaaaagttactttacgtagttacgacaaacgggtaacggacggggtacccgttagggtaaacttttaacgttaccgtttttacggaaaccccgtacgggttacgggggtaccccttacgggggtaaaacccccttggggttacccgttaaaccccgggttccttacccccgttaccgaaccggtacccccttaccccggaaaaccccggtaaccgggggtacccccttaaccggtttcccggggtttccccccg

SEQ ID NO: 435685 - DNA, 571 bp, Homo sapiens
  misc_feature: GZ8MTXP02IV5L4.45.38.D05.1.454.CMB.2.raw
  modified_base (227)..(227): a, c, t, g, unknown or other
  modified_base (302)..(302): a, c, t, g, unknown or other
  modified_base (473)..(473): a, c, t, g, unknown or other
  modified_base (557)..(557): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctcgtgtctgggtctctggacagtcgatcaccatggcctgcactgtaaccaanagtgattggttgggtagtttttagtttgtctctggtaccaacaacacccggcaacgacccccaaatatcatttanaggacactaaggccggtcccgtggggtttacaagttccgctttctctggctcaagtcctggcaacgacgcctccctgacatctctgggcctcgagctacgaggacaggctagtatttatttctgttgctcattagcgacgagggtaccagcctacgttgggtcgttcgggnggaacggctaggttcgaccgtcgtacggtcacgtacccgaagtccgtaccgccccgttacgtcctaccgttcgtccgtaccccnccgttcctcgtccg

SEQ ID NO: 435686 - DNA, 518 bp, Homo sapiens
  misc_feature: GZ8MTXP02FRBJE.45.38.D05.1.454.CMB.2.raw
  modified_base (228)..(228): a, c, t, g, unknown or other
  modified_base (264)..(264): a, c, t, g, unknown or other
  modified_base (270)..(270): a, c, t, g, unknown or other
  modified_base (292)..(292): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccangtgatgttggattttgttgtctctgtaccaacaacncccggnaacgaccccaaatatcatttanaggacactaagcggcctggggttcaagtcgctctctgctcagtcctgcaacgcgcctccctagcactctcgtggcctcaggctgagacgagctgattatactgctgctcaatgtgcgagttagtagttacttggtgttcgggcggagggtccaagctcgacgtcgtaggcacggccacggctccgtccccgtggtacctcgttcgtccgttcccaccttccttccg

SEQ ID NO: 435687 - DNA, 728 bp, Homo sapiens
  misc_feature: GZ8MTXP02IU097.45.38.D05.1.454.CMB.2.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtcgactccatcagtagtagtcaattaaatttggggctggccgcacgcccccaggggaacgggctgggagtggagttggactgtctactcgtaggtacgggaccaaccctattacacggccccgtccctacgaacgtacctacgacgtggtgtacttaccgtacaactaaactaccgtaaccaaacgtaaaccctaatttcctacccttagacggtcctagaaactcgtgtacgacccggccggacggaaccgaaccggaccctaaaaattacttaccgtacggttcgaccgaaaggacggaacggggtaccctaggggttaaactttaaccgttaccgttttaccgaaccgtaaccgggttcgggggtacccgtttaaccggggtaaacccccgttggggtaccccgtaacccgtttcccgtaccccgttaccgaaccggtacccccttacccaaccccggaaccggggtacccctaccggttccccgggtttacccccc

SEQ ID NO: 435688 - DNA, 685 bp, Homo sapiens
  misc_feature: GZ8MTXP02FZOQK.45.38.D05.1.454.CMB.2.raw
tcagacgcgatcgacacgaccggtgctcgatttagtatctgatagttgggtttggggacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcattaaagtttggggctgggtccgccagcccccgagggaaggagcgtggagtggagttgggactgtctactgtaggtcggacctacctattacacgccccgtcctacaacgactcgacgtgtgatctccaaataaaccacgttaccaaagaacccaattcctccctgacgtctgaactcgtgtacgaccgtcccgacgacacgggaccaaatacttacgtgtacgacgaagaggacgggtcctagggtaatttacttaccgtttagaacccgtacggtcggggtcccgttacggggaaccccttcgggtccgtaacccgttccgttaccctacgtaccggcccttacccgaacccgtaaccgggggtacccccttaacggtccccggtttccccttaccccccggtacggggtaccccctacccccggtttaccccgtacccgtaaaacccggg

SEQ ID NO: 435689 - DNA, 676 bp, Homo sapiens
  misc_feature: GZ8MTXP02G3TYQ.45.38.D05.1.454.CMB.2.raw
  modified_base (367)..(367): a, c, t, g, unknown or other
tcagacgcgatcgacacgaccggtgctcgatttagtatctgatagttgggtttggggacggacctcctgtgcaggaaaaatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcattaaagttttgggctggtccgccgacgccccgagggaagggctaggagtggagttgggactgtactacgtcgtagtcggacctactattacacgcccgtccacaagctcgactggtacatctacaataaaccncgtaccaaagaccaattcctccgtgacgctacgaactcgtgtacgacccgccgaccggaacgtaccggaacctaaaagttacgtttacgtaggtagaaccgaaaggacggtacggggtacccttaagggtaaactttacgttacccgtttaggaacccgtacggtcgggggaccgttacggggtaaccctcgggtaccctaccggtcctcccgtacacgtccctacccgaaaccggtacggccctacggttcccggtcccttaacccccgtcggacccctaacccctccgtaaccgaacgtaccacccg

SEQ ID NO: 435690 - DNA, 755 bp, Homo sapiens
  misc_feature: GZ8MTXP02GORA7.45.38.D05.1.454.CMB.2.raw
  modified_base (269)..(269): a, c, t, g, unknown or other
  modified_base (301)..(301): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggtgggtagttataaccttgtctctgtaccaangcaccagacaacgaccccaaatatctatttanaggacacgtaacgcggtcccgttaggggttacaagtcgtacttcgtacgtcggactaccgaagtctacggaccaaccgtaccgggcccccttacccgtacggaaacctaaacgttcccgttacggttccggggtacccttacccggaaacggtacccgttaaccggaacggggaaaccggtaacggggtaccctttaagggtaacgtttttaactttccgtttggtttacgtccttacttaagttaacgttcggaaccggtaacgggggaacccctaggtaccgttaacgggtttcgggggttcgggtttaccggggacgggggtaaccgggtaccggttacggggttaccggtaccccggttacggttaaacgggttccgaaccggtacccgaacgggtcctccccggacccccgttcggtaccctaccgttcccgtacccggtttccccccg

SEQ ID NO: 435691 - DNA, 620 bp, Homo sapiens
  misc_feature: GZ8MTXP02IS2UR.45.38.D05.1.454.CMB.2.raw
  modified_base (228)..(228): a, c, t, g, unknown or other
  modified_base (267)..(267): a, c, t, g, unknown or other
  modified_base (271)..(271): a, c, t, g, unknown or other
  modified_base (288)..(288): a, c, t, g, unknown or other
  modified_base (293)..(293): a, c, t, g, unknown or other
  modified_base (432)..(432): a, c, t, g, unknown or other
  modified_base (601)..(601): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgccctcgtgtctgggtctcctggacagtcgatccacatggcctgcactgaaccaanagtgatggttggtattttgttgctctgaccacacaccgnaacnccccaaatatctattanagganactagccgtccgtggggttcagtcgtcttctcgtgcctacagtccctggacaacgccgcccttccctagactatcctcgtcgggccctcgacgggctgacggacgagcgtgttaatttgtttccgtgttcgtaccttanagttagtcgacgaacggggaccacggtcctaacgggtttggggtcggttcggggacgggtaacgggtaccgtgggttacgacccggtttaccgtacggttaccgaccggacccgtaacggtcccgtaccggcccccgttaggtccctaccgttccttcccgttaccccnccccgtttcctccgttccg

SEQ ID NO: 435692 - DNA, 514 bp, Homo sapiens
  misc_feature: GZ8MTXP02JJP23.45.38.D05.1.454.CMB.2.raw
  modified_base (227)..(227): a, c, t, g, unknown or other
  modified_base (274)..(274): a, c, t, g, unknown or other
  modified_base (298)..(298): a, c, t, g, unknown or other
  modified_base (328)..(328): a, c, t, g, unknown or other
  modified_base (411)..(411): a, c, t, g, unknown or other
  modified_base (417)..(417): a, c, t, g, unknown or other
  modified_base (421)..(421): a, c, t, g, unknown or other
  modified_base (425)..(425): a, c, t, g, unknown or other
  modified_base (450)..(450): a, c, t, g, unknown or other
  modified_base (483)..(483): a, c, t, g, unknown or other
  modified_base (498)..(498): a, c, t, g, unknown or other
  modified_base (513)..(513): a, c, t, g, unknown or other
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatgttggattttagtttgtctcctggtaccaacaacacccggngaacgcccccaaataatcatttanaggacactaagcgccctggggttcagtcgnttctctgctcaagtcctgcaacacggcctcctagaccaatctcgtacgggctccaggcctagacgacgagctgtattatttcngttacnctanatangacgaggacagctagtggtgtcggnggacggcgtagtcacgtcaggtcacgccagccnccgcccgtgcactcnctcccaccgtctacnc

SEQ ID NO: 435693 - DNA, 660 bp, Homo sapiens
  misc_feature: GZ8MTXP02G96FZ.45.38.D05.1.454.CMB.2.raw
  modified_base (227)..(227): a, c, t, g, unknown or other
  modified_base (512)..(512): a, c, t, g, unknown or other
  modified_base (625)..(625): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctggtctcctggacagtcgatcacatggcctgcactaggaaccanagtgattggttgggttagtttttagtttgtctccgtacgtaaccaacaaccgaccccggacgaaaccgacccccaaaataactctaatttaagtacggaacctaacgtaacggtcccggtacccggttcgggggtttacaacggttcgtcctttcgtcgtcggtcctaccgtaagtccgtagaccaaccgaccggtccctcccgtacgacctaactctccgtcggtacctaccgacggcctacgaaggacgagacttagttatttatttcgtgttcgtcctatanagtcgacgtacggaccagtacgtacggttgggtcgtcggggacggacggtacgtagggtacgaccgtcgtacggtacaccggccgaacggtcctccgggcccctcggtaaccnccgttccgtccgtcccccgtcccttccgtcgtccg

SEQ ID NO: 435694 - DNA, 706 bp, Homo sapiens
  misc_feature: GZ8MTXP02GS3M4.45.38.D05.1.454.CMB.2.raw
  modified_base (232)..(232): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatcggcctgcacgtggaaccaacngtgattggttgggtattttagtttgtctccgtgtaccaacaccacccggacaacgaccccaaatatctatttagtaggacacgtaagcggtcccgttcggggttacacgtcgtcttctcgtcgcctcgaagtcccgtagaccaacaccggtccctcccgtagacctactctccgtcgggcctcgacggtccctacgaggaccgacggtcgtgttaacgtttcgtttacgtgttcgtacctacgtaagttaagtcggacgacggacccgtaggtaccgtaacggtttggggtacgggtttccggggacggggtaaacgggtcccgtaaacggggtttccggaaccccggtttccggtacgggtttaccgaccggtaaccccggaacggtcccgtaccccggtcccccgttaaccggtcctaacccccgtttcgttacccccgttacccccgtaccccttcccgtaccgttcccgg

SEQ ID NO: 435695 - DNA, 738 bp, Homo sapiens
  misc_feature: GZ8MTXP02IZTJ8.45.38.D05.1.454.CMB.2.raw
  modified_base (228)..(228): a, c, t, g, unknown or other
  modified_base (272)..(272): a, c, t, g, unknown or other
  modified_base (321)..(321): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccangtgattggttgggtattttgttgtctctgtaccaacacacccgnaacgccccaaatatcattataggacactagcgccgtggggttcaggtcncttctcgtgctcgaagtccgtggacctacaccggtccctccccttagacctaacttcctcgtcggggcctacgacggtcctacgacggacggacggcgttaggtatttacgtttcgttaggtttcggtacttcgtaatttacgttacggaccgtaaacgggggtaccaacgggttccggtaaaccgggtttcgggggtttacgggttccgggggacgggggtaaccggggttaacccggtaagggggttttcccgggaaaccccggttttcccggtaaacgggtttacgacccggggtaaccccgaaacggggttccccgttcccgggtccccccccgttaaggggtccccttaacccggttacccttccccggtttaacccccgtacccccctttcccggtttaacccctcccggg

SEQ ID NO: 435696 - DNA, 793 bp, Homo sapiens
  misc_feature: GZ8MTXP02FWZMT.45.38.D05.1.454.CMB.2.raw
  modified_base (168)..(168): a, c, t, g, unknown or other
  modified_base (210)..(210): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggngtcgggccaggactggtgaagccttcggagaccctgtccctnacttgctagtgtctctggtcactccatcagtagtatcattaaagtttgggctggtccgcacggccccgagggaagggctggagtggagttgggactgtccttactcgtaggtcgggaccctacctattaccgacgtccccgtcctacgaagaccctcgtacctggtacgagttacctactaaactaaaccgaccgttaaccaaaacgtaaaccctaaatttcccgtaccccgtaggtaacggtaccgttaacgaaaaccgttccgttacggtaccggaccccggtacccggaccgggaacccgtaaaccggggaaccctaaaaacgtttacgttaaaccgtagttacggaacgtaaaacgggtacggaacggggtacccgttaagggtaaactttaccggttcctttaacggacccgtaacgggtcggggtaccccgttagggggtaaaacccccgtttgggtaccccgtaacccgtttcccgtacccgttaaccgtccccggtaaccccgttaacccccggaaaacccgggttaaaacccgggcccccgtttaaacggttcccccggttttaacccccccgg

SEQ ID NO: 435697 - DNA, 602 bp, Homo sapiens
  misc_feature: GZ8MTXP02HF7DP.45.38.D05.1.454.CMB.2.raw
  modified_base (230)..(230): a, c, t, g, unknown or other
  modified_base (315)..(315): a, c, t, g, unknown or other
  modified_base (365)..(365): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtacataaaatttggggactgggtccgccagccccagggaaggggctggagtggattgggactgtctacntagtgggaccacctattacagcccgtccctacaagacctcgactgggtanatctacaataaacaacgtaaccaaacgaaacctaattcctaccctagacgactagaactcgtgtacgaccgcgacgaacaccgactaaaatacttactgtagaacaagaaggaggacgtacgtaagttacttacgttacgtaccgtacggtacgggtacggtacggtaaccgtacggtacgtaccgtcctcctccgaacgtcctacccaccgaaccggacccgtacgtaccgtcccg

SEQ ID NO: 435698 - DNA, 624 bp, Homo sapiens
  misc_feature: GZ8MTXP02FIM17.45.38.D05.1.454.CMB.2.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctgggtccgccaggccccccaggggaaggggctgggagtggattgggactgtctactctagtgggaccacctattacagcccgtcctcaagacctcgactggtgatctcataaacacgtaccaaagaaccaaattcctccctagacggcttagaaactctgtgacccgccgcggacacggacaaatatactgtgacaagagacggggccttagggaaatttactccgtttacgaccgtaaccgttcgggggcccttagggggtaaacccccgtggggttacccaacccggttcctcccttaccgaacggccccttacccgacccgtaaaccgggggccccctaacgtcccggttacccccccgg

SEQ ID NO: 435699 - DNA, 565 bp, Homo sapiens
  misc_feature: GZ8MTXP02FOA0C.45.38.D05.1.454.CMB.2.raw
  modified_base (180)..(180): a, c, t, g, unknown or other
  modified_base (436)..(436): a, c, t, g, unknown or other
  modified_base (448)..(448): a, c, t, g, unknown or other
tcagacgcgatcgacacgaccggtgctcgatttagtatctgatagttgggttgggggggtcacaagaggcagcgctctcgggacgtctccaccatggcctgggctctgctgctcctcactctcctcactcaggacacaggatcgtgggccctttctgccctgactcagcctgcctccgtntctgggtctcctggacagtcgatcaccatggcctgcactggaaccaacagtgatggttggggatttttagtttgtctctggtacccaacaacaccccggcgaaacgcccccaaaactaactcaatttatagggacactaaagcggcccgtcggggtttcaagtcgcttctctggctccaagtcctggcaacacggcctccctgacaatctctgggctcagctcagacgagctgatttattctgttgctacagttangacgacggaccngtactacgttgggtcgtcggcggacggaccgaggttcgacccgtacgtacgcgacgacccgaacgccgtccgccccgtacgtccgtaccgtcgttccgtccccgccctcctcctacg

SEQ ID NO: 435700 - DNA, 627 bp, Homo sapiens
  misc_feature: GZ8MTXP02FWIV3.45.38.D05.1.454.CMB.2.raw
  modified_base (229)..(229): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggccaggactggtgaagccttcggagaccctgtccctcacttgcagtgtctctggtnactcatcagtagtatcattaagtttgggctggtccgcacgccccgagggaagggctggagtggagttgggactgtctactcgtacgtcgggacctactattacgacgtccccgtcctacaacgcctcgacgtggtagtatacctacaactaaaccacgtaccaaacgtaacctaagttcctacccgtagacggtctacgaacttcgtcgtacgacccgccggacggaccaccggactaaattacttactgtgacgaaggagacgggaccttaggtactttacgtaccgttacgaaccgtcggtacggggccgtacgggaacccgttcgggtacctaccgttcctccgtacgaaccgtaccctacccgacccgtaccggccctacgttccggttccccg

SEQ ID NO: 435701 - DNA, 603 bp, Homo sapiens
  misc_feature: GZ8MTXP02GZD8H.45.38.D05.1.454.CMB.2.raw
  modified_base (317)..(317): a, c, t, g, unknown or other
  modified_base (360)..(360): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcacatggcctgcactggaaccaacagtgatggttgggattttagtttgtctctggtaccaacaacaccaggcaaagcccccaaatcatgattatgaggcagtaagcggcctanaggggtttcaatcgcttctcgtcggcctcaagtctggacaacncggtcctacctgaacctaatcctacgtcgggcctccgaggtcctaggacggacgtaggcctaggtaatttagtactgctgctacatactgactaaggttatagttacgtttgggtacgtttcggggacggtaggggtaaccctaaggtccgttacggacccgttacgtacgggttaccaaccgtacccgaaagggtccctccggtaccccccgtgggttacccaaccgttccgtttaccccgg

SEQ ID NO: 435702 - DNA, 661 bp, Homo sapiens
  misc_feature: GZ8MTXP02J0R1Y.45.38.D05.1.454.CMB.2.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgacctccatcagtagtatcaattaagtttggggctggtccgccacgccccgaggggacgggcgtggagtggagttggactgtctactcgtaggtcggaccactatacacgtcccgtcctacaagtccctacgacgtggtgatcacataaacacgtaccaaagaacctaacttcctccctagacgtctacgaaacttcgtgtacgacccgccgacggaccacggaccaaaattacttaacgtgtagacaaagggaggacggtaccgtaggtaaactttacgttaccgtttacgaaccgtacggttccgggggtacccgtacggggtaaacccccgttggtaccccgtacccgttcccgttaccccgtcgaacccggtacccctaccccgaaacccggtaaccgggccccctaacggttccccggtttaccccc

SEQ ID NO: 435703 - DNA, 797 bp, Homo sapiens
  misc_feature: GZ8MTXP02IG50Z.45.38.D05.1.454.CMB.2.raw
  modified_base (254)..(254): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaacgccttcggacgaccctgtccctcacttgctagtgtctcgtggtcgactccatcagtagtacgtnaattaaagtttggggctacgggtccgccacgcccccgtaggggaacgggcgtggagtcggtagttgggctgttcctacgttccgtaggttcggggaaccctaacccttacttaccgacgtccccgtaccctacaacgaccccgtcggactggtacgtattacctaacaactaaaccgtaaccgtaacgaaaaccgaacctaaacttccgtccccttagacggtccgtagaacccgttctacgggtaccgacccgggaccggtaccgggaaacccgaacgggacccctaaaaagttaccgtttaaaccgtagggttacgaaccgtaaagggaccgggtaacgggtacccggtaaggttaaactttaaccgttacccgttttacgggtaaccctaccgggggttacggggtaccccggttaccggggtaaacccccggttcggtacccgtaacccggttcccctacccgtacccgaaccgtcccccgttaccgaaccccggtaacccggggtacccccttaacggttccccgggtttcccccccg

SEQ ID NO: 435704 - DNA, 555 bp, Homo sapiens
  misc_feature: GZ8MTXP02HZRWX.45.38.D05.1.454.CMB.2.raw
  modified_base (294)..(294): a, c, t, g, unknown or other
  modified_base (300)..(300): a, c, t, g, unknown or other
  modified_base (334)..(334): a, c, t, g, unknown or other
  modified_base (358)..(358): a, c, t, g, unknown or other
  modified_base (365)..(365): a, c, t, g, unknown or other
  modified_base (415)..(415): a, c, t, g, unknown or other
  modified_base (421)..(421): a, c, t, g, unknown or other
tcagacgcgatcgacacgaccggtgctcgatttagtatctgatagttgagtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttggtatttttagttgtctcctggtaccaaccaacaccccgacaacgcccccaaatatnatttanaggacacaagccgccgttggggttcagtcgcttnctgctcagtctgcacacgcctccngacatcnctcggctcgagctgaggacgaggctgttactttagtttctgttagtctanattagngacgacggactacggtcgtacggttcgggttacgttcgggacgggtacggtaccgtaggttcggtaccgtcgtacggcaccgaccgacgtccctcccgcccgtcgtctcgtcctacccgtcccctccctcctcg

SEQ ID NO: 435705 - DNA, 596 bp, Homo sapiens
  misc_feature: GZ8MTXP02HQGMS.45.38.D05.1.454.CMB.2.raw
  modified_base (228)..(228): a, c, t, g, unknown or other
  modified_base (306)..(306): a, c, t, g, unknown or other
  modified_base (375)..(375): a, c, t, g, unknown or other
  modified_base (384)..(384): a, c, t, g, unknown or other
  modified_base (417)..(417): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgatggttgggtagttttagtttgtctcctggtaccaacaacaccccggcgaacgcccccaaactaactcatttanaggacactaagcggccctcggggtttcaagtcgtcttctctggcctcacgtcctgcaacacgcctcccngcaatctcncgggctccgagctcgaggcgaggcctgaatttnttcttgtgtctcagttatgcagggccagtctacgttggggtgttcgggcggtaagggtcctaaggggttcgaacccggttcgtaacgggtccgaacgacccgaacgggtcctcccggacccccgtggtaacccgacccgttccgttccgttcccccggcccctttcccttcgttaccgg

SEQ ID NO: 435706 - DNA, 857 bp, Homo sapiens
  misc_feature: GZ8MTXP02FITDA.45.38.D05.1.454.CMB.2.raw
  modified_base (234)..(234): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatcggcctgcacgtaggaaccaanagtgatggttgggtattttgttgtctctggtaccaacaaccgaccccggacgaaccgaccccaaataactactaatttagaaggacacgtaacggccggtcccgtcggggtttcaacggttcgtttctcgtcggtcctaccgtaacgttcgtaccggtaccaaccgtaccggtccccttacccgtacgtaactacctccgtccgttcgggggcccttaccggacgggtacccgttacggaacggggtaaccggacgggtacgtttacggttaaactttttaagtttttccctaggggttttacgtcccgtttataaacgtttaagttcccggggaaaccggaaaccgggggtaaccccgtaacgggttacccgtttaaccgggggtttagggggtttcccggggtttacgggggacccgggggttaaacgggggtaccccggttaaacgggggtttcccggtaaaccccgggtttacccgggttaacggggttacccgaaaccgggtaacccccggtaaacgggttccccgtcccccggtaccccccggttcgggttacccctaaccgtttcccgtttaccccggttcccccttaccctttccccgtaccgtccgttacccgg

SEQ ID NO: 435707 - DNA, 614 bp, Homo sapiens
  misc_feature: GZ8MTXP02FKG1K.45.38.D05.1.454.CMB.2.raw
  modified_base (307)..(307): a, c, t, g, unknown or other
  modified_base (457)..(457): a, c, t, g, unknown or other
  modified_base (464)..(464): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagtttttagtttgtctctggtaccaacaacaccccggcgaacgacccccaaatcatgatttangaggcagtagcgcctgagggtttctatcgcttctcgtgccctccatctggacaaccaccgggtccctccctagaccaattcctcgtcgggcctccgaggcctagggaacggaccggagtaccgtagtaatttacttactcgtctgcctanaacgttntacgtagtaaggttagttagttacggtttgggtcggttacgggacgggaacgggacgaacggtcgtacgtacccgtacgtacggaccgaccgacccgtacggcccgtcccgtacccccgtcgtacctacccgttccgttcccgttccccg

SEQ ID NO: 435708 - DNA, 640 bp, Homo sapiens
  misc_feature: GZ8MTXP02FQHLA.45.38.D05.1.454.CMB.2.raw
  modified_base (158)..(158): a, c, t, g, unknown or other
  modified_base (230)..(230): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttcngccctgactcagcctgcctcgtgtctgggtctcctggacagtcgatcaccatggcctgcactggaaccaacngtgatggttgggtagtttttagtttgtctctgtaccaacaacacccggcgaacgaccccaaactaactctaatttagtaggacactaagccggtcccgtcgggggtttcaacgtcgtcttctcgtggctccgaagtccctaggcaaacgccggtacctccctgaccaactctacgtgggcctcgaggctacgaggacgagctgtatttagttctgttcgctactatataggcgaaggggaccaggtcgtaacgttcggggttacggttccgggacggggtacgggaccgtaggggttcgaacccggtaccgtaggtccgacgaaccccggaacggtcccgtaccggtcccccgttagggtcccctacgttccgttcccggttcccccgtcccttcccgtccgtttaccgg

SEQ ID NO: 435709 - DNA, 670 bp, Homo sapiens
  misc_feature: GZ8MTXP02IZCQ7.45.38.D05.1.454.CMB.2.raw
  modified_base (198)..(198): a, c, t, g, unknown or other
  modified_base (228)..(228): a, c, t, g, unknown or other
  modified_base (348)..(348): a, c, t, g, unknown or other
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcggtcgggccctttctgccctgacctcagcctgcctcgtgtctggtctctggacngtcatcacatggcctgcaactgaaccaagngtgattggttgggtattttgttgctctgaccaacaaccgcccgagaaccaccccaaatatactaagtttacgaaggaactaacgtagccggtacccgttggggttaccagtccgtcttcncgtgtcctacgtagtcctaggaccaacgaccgccctaccgcgactatcgtcgacgggtcctaccgagtcgtaccgaagggaacgtacggtcgttacggttaattttacgtttaccgtaggtttcgactactattaacgtggaccggaaacgggtaccgacggtacggttacgggttaggggtaccggttcggggacggtaacgggtaccgtacgggttaccgaccgttacggtacggtaccgaccgaaccgtacggtccgtaccccgtcccgtacggtaaccctacgtcccgttccctacccctacccgttccgtactaccg

SEQ ID NO: 435710 - DNA, 566 bp, Homo sapiens
  misc_feature: GZ8MTXP02JERY2.45.38.D05.1.454.CMB.2.raw
  modified_base (264)..(264): a, c, t, g, unknown or other
  modified_base (268)..(268): a, c, t, g, unknown or other
  modified_base (271)..(271): a, c, t, g, unknown or other
  modified_base (416)..(416): a, c, t, g, unknown or other
  modified_base (524)..(524): a, c, t, g, unknown or other
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttggattttagttgtctctgtacaacacnccgnacncccaaatatcattagaggacactagccgccgtcggggttcaagtcgtctctcgtgctaccgaagtcctcggccaacgacggccctaccctagactaactcctcgtcgggccttcgagcctacgaggtaccgagtctgtaactttnttcgtgttgctcatagtacgcgacggtacagcgtacgttggggtcgttacggggcggtacggtacgtagggtcgtaccgtacgtacggtcacggtaccgaacggtccncccgtcccgtcgtctccgtctccgtccctcctccctcgtccg

SEQ ID NO: 435711 - DNA, 642 bp, Homo sapiens
  misc_feature: GZ8MTXP02HE8JI.45.38.D05.1.454.CMB.2.raw
  modified_base (235)..(235): a, c, t, g, unknown or other
  modified_base (372)..(372): a, c, t, g, unknown or other
  modified_base (386)..(386): a, c, t, g, unknown or other
  modified_base (400)..(400): a, c, t, g, unknown or other
  modified_base (433)..(433): a, c, t, g, unknown or other
tcagacgcgatcgacacgaccggtgctcgatttagtatctgatagttgagtttgggggtcacaagaggcagcgctctcgggacgtctccaccatggcctgggctctgctgctcctcactctcctcactcaggacacaggatcggtgggcccttttctgccctgactcagcctgcctccgtgtcgtggtctccgtgacagtcgatcaccagtcgcctgcacgtaggaaaccaacgngtagtagttggttagggttagttttttagtttgtctcgtacggtaaccaaacgaaccgacccggacgaaccgaccccaaatactctaatttagacggactacgacgcggtccggttcggggttacacgtcgtcttcncgtgactcacgtcngacacgcgcctcgngactatcgtacgcggctcgcgctcgagggacgnggtactgttactttagttctggtcacttcaaagtcgtcggacgacggtacctacggtcttacgggttcggttacggggtaccgggacggggaaccggttaacggttcggaccggttacccgtacggtaggtacccgacgtacccggacgtcccgtcccgtccccgtggtcctaccgttccgttcccgtcccctaccccgttcgttaccg

SEQ ID NO: 435712 - DNA, 606 bp, Homo sapiens
  misc_feature: GZ8MTXP02HDNCR.45.38.D05.1.454.CMB.2.raw
  modified_base (230)..(230): a, c, t, g, unknown or other
  modified_base (253)..(253): a, c, t, g, unknown or other
  modified_base (289)..(289): a, c, t, g, unknown or other
  modified_base (296)..(296): a, c, t, g, unknown or other
  modified_base (331)..(331): a, c, t, g, unknown or other
  modified_base (440)..(440): a, c, t, g, unknown or other
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcgatcaccatcggcctgcactggaaccaangtgatggttggtattttagtttnctctggtaccaacacacccggcaacgccccaaatanctattanaggacagtaagcgccgtggggttcaagtcgcttcnctggctccgaagtcctacggactaacgaccggtcctccctgacctaatctcgtgggctccgagtctacgaggacgagtctagtatttattcgtgttctacctatattancgaccgagggaccagacgtacgttggggtagttcgggacgggacggtacgtacgggtttcgacccggttacgtacggtaccgacgtacccgaaacgggtcctacccgggtaccccttcggtaacctacgttccgtcccgtttacccaccccgtttcctacgtccgg

SEQ ID NO: 435713 - DNA, 637 bp, Homo sapiens
  misc_feature: GZ8MTXP02HRRP3.45.38.D05.1.454.CMB.2.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcgggagaccctgtccctcacttgcagtgtctctggtgactccatcagttagtagtctattaaagtttggggctgggtccgccgacgcccccgaaggggacggggctgggagtggagtttgggacttgtctactcgtagtcgggacctacctatacacgtccccgtacctcgaacgcctcgtactggtagatctacaataaacacctacaaacgaacctaattcctaccctagacgtactagaactctcgtacgaccccgcggaccggacacggacctaaatacttactggtagacgaaggaggacggtccgtaggtaatttacgtacctttacggaccgtacggtcggggaccgttacgggtaacccctgggtaccctacccggtacctcccgtcaaccgaccctacccgaccgaaccggccctacgttcccggtttaccccc

SEQ ID NO: 435714 - DNA, 580 bp, Homo sapiens
  misc_feature: GZ8MTXP02JOMZE.45.38.D05.1.454.CMB.2.raw
  modified_base (230)..(230): a, c, t, g, unknown or other
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaatttggggctggtccgccagcccccagggaaggggctggagtggagttgggactgtctactctagtgggaccactattacagccccgtccctcaagacctcgactggtgatctacaataaacacgtaccaaagaaaccaattcctaccctagacggctagaaacctctgtacgacccgccgacggacacggaccaaaatattactgtacgacaaggagaagggcctaggaattatccgtttagacctacgtacggggcctacgggaaccctgggtccaccgttcctcctcgaacgccctacgaaccgacggcccacgtccgttccccg

SEQ ID NO: 435715 - DNA, 246 bp, Homo sapiens
  misc_feature: GZ8MTXP01BVTZN.39.75.G09.1.454.CMB.2.raw
  modified_base (245)..(246): a, c, t, g, unknown or other
tcagtcgcactagtcacgaccggtgctcgatttagtatagacatcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccactagtgcgactgagcgggctggcaaggcgcatagnn

SEQ ID NO: 435716 - DNA, 243 bp, Homo sapiens
  misc_feature: GZ8MTXP01ECDUF.39.75.G09.1.454.CMB.2.raw
  modified_base (243)..(243): a, c, t, g, unknown or other
tcagtcgcactagtcacgaccggtgctcgatttagtatagacatcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccactagtgcgactgagcgggctggcaaggcgcatagn

SEQ ID NO: 435717 - DNA, 245 bp, Homo sapiens
  misc_feature: GZ8MTXP01DVJCP.39.75.G09.1.454.CMB.2.raw
  modified_base (243)..(245): a, c, t, g, unknown or other
tcagtcgcactagtcacgaccggtgctcgatttagtatagacatcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccactagtgcgactgagcgggctggcaaggcgcatagnnn

SEQ ID NO: 435718 - DNA, 249 bp, Homo sapiens
  misc_feature: GZ8MTXP01BJZJ6.39.75.G09.1.454.CMB.2.raw
  modified_base (244)..(249): a, c, t, g, unknown or other
tcagtcgcactagtcacgaccggtgctcgatttagtatagacatcagggtcttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctggtcaaggactacttccactagtgcgactgagcgggctggcaaggcgcatagnnnnnn

SEQ ID NO: 435719 - DNA, 244 bp, Homo sapiens
  misc_feature: GZ8MTXP02GJIV8.39.75.G09.1.454.CMB.2.raw
  modified_base (244)..(244): a, c, t, g, unknown or other
tcagtcgcactagtcacgaccggtgctcgatttagtatagacatcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccactagtgcgactgagcgggctggcaaggcgcatagn

SEQ ID NO: 435720 - DNA, 245 bp, Homo sapiens
  misc_feature: GZ8MTXP02GZ3F3.39.75.G09.1.454.CMB.2.raw
  modified_base (244)..(245): a, c, t, g, unknown or other
tcagtcgcactagtcacgaccggtgctcgatttagtatagacatcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccactagtgcgactgagcgggctggcaaggcgcatagnn

SEQ ID NO: 435721 - DNA, 247 bp, Homo sapiens
  misc_feature: GZ8MTXP02IAGL2.39.75.G09.1.454.CMB.2.raw
  modified_base (244)..(247): a, c, t, g, unknown or other
tcagtcgcactagtcacgaccggtgctcgatttagtatagacatcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccactagtgcgactgagcgggctggcaaggcgcatagnnnn

SEQ ID NO: 435722 - DNA, 395 bp, Homo sapiens
  misc_feature: GZ8MTXP01BCN4D.3.57.F02.1.454.CMB.2.raw
  modified_base (392)..(395): a, c, t, g, unknown or other
tcagagacgcactccacgaccggtgctcgatttagctcgatatagttgggtttggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggcttcggcggcgggaccaagctgaccgtctatgtcaacccaagtctggcccctcggtcactctgttccccacctcctcgacgtgcgtctctgaagcgggctgggcaagggcgcatagnnnn

SEQ ID NO: 435723 - DNA, 399 bp, Homo sapiens
  misc_feature: GZ8MTXP01EZIFD.3.57.F02.1.454.CMB.2.raw
  modified_base (393)..(399): a, c, t, g, unknown or other
tcagagacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtctatgtcaacccaggctggcccctggtcactctgttccccgccctcctcgacgtgcgtctctgaagcgggctgggcaagggcgcatagnnnnnnn

SEQ ID NO: 435724 - DNA, 393 bp, Homo sapiens
  misc_feature: GZ8MTXP01BMUS5.3.57.F02.1.454.CMB.2.raw
  modified_base (385)..(385): a, c, t, g, unknown or other
  modified_base (391)..(393): a, c, t, g, unknown or other
tcagagacgcactccacgaccggtgctcgatttagctcgatatagttgggtttgggggtgtggtggtctccactcccgccttgacgggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggcttcggcggcgggaccaagctgaccgtctatgtcaacccaggctggcccctcggtcactctgttccccacctcctcgacgtcgcgtctctgaagcgggctggcaagggcncatagnnn

SEQ ID NO: 435725 - DNA, 384 bp, Homo sapiens
  misc_feature: GZ8MTXP01DJHL9.3.57.F02.1.454.CMB.2.raw
  modified_base (237)..(237): a, c, t, g, unknown or other
  modified_base (375)..(375): a, c, t, g, unknown or other
  modified_base (381)..(384): a, c, t, g, unknown or other
tcagagacgcactccacgaccggtgctcgatttagctcgatatagttgggtttggggtgtggtggtctccactcccgccttgacgggctgctatctgccttccaggcccctatcctggtcatcaattatgacagcgaccggcctcagggatccctgagcgattctctggctccaactctgggaacacggccaccctgaccatcaccagggtcaggccgaggatgaggccatattacngtcaggtgtgggatagccgttctgatcattgggcttcggcggcggacaagctgaccgtctatgtcaacccaaggctggcccctggtcactctgttcccaccctctcgagtgcgtctctgaagcgggctggcaagggcncatagnnnn

SEQ ID NO: 435726 - DNA, 402 bp, Homo sapiens
  misc_feature: GZ8MTXP01DYC72.3.57.F02.1.454.CMB.2.raw
  modified_base (398)..(402): a, c, t, g, unknown or other
tcagagacgcactccacgaccggtgctcgatttagctcgatatagttgggtttggggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctggtcactctcgttccccaccctctcgagtcgcgtctctgaacgcgggctgggcaaagggcgcatagnnnnn

SEQ ID NO: 435727 - DNA, 397 bp, Homo sapiens
  misc_feature: GZ8MTXP01B1J13.3.57.F02.1.454.CMB.2.raw
  modified_base (265)..(265): a, c, t, g, unknown or other
  modified_base (393)..(397): a, c, t, g, unknown or other
tcagagacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttntgatcattgggtcttcgggcggcgggaccaagctgaccgtctatgtcaaccaggctggcccctggtcactctcgttccccacctctcgacgtgcgtctctgaacgcgggctgggcaagggcgcatagnnnnn

SEQ ID NO: 435728 - DNA, 401 bp, Homo sapiens
  misc_feature: GZ8MTXP01E4GZQ.3.57.F02.1.454.CMB.2.raw
  modified_base (397)..(401): a, c, t, g, unknown or other
tcagagacgcactccacgaccggtgctcgatttagctcgatatagttgggtttggggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggcttcggcggcgggaccaagctgaccgtctatgtacaacccaggctcggcccctggtcactctcgttccccacctctcgacgtcgcgtctctgaaggcgggctgggcaaagggcgcatagnnnnn

SEQ ID NO: 435729 - DNA, 394 bp, Homo sapiens
  misc_feature: GZ8MTXP01C3CMJ.3.57.F02.1.454.CMB.2.raw
  modified_base (390)..(394): a, c, t, g, unknown or other
tcagagacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggcttcggcggcgggaccaagctgaccgtctatgtcaacccaaggctggcccctggtcactctgttcccgctctcctcgagtgcgtctctgagcgggctgggcaaggcgacatagnnnnn

SEQ ID NO: 435730 - DNA, 391 bp, Homo sapiens
  misc_feature: GZ8MTXP01EGZ0M.3.57.F02.1.454.CMB.2.raw
  modified_base (358)..(358): a, c, t, g, unknown or other
  modified_base (388)..(391): a, c, t, g, unknown or other
tcagagacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcaggccgaggatgaggccgactattactgtcaggtgtgggatagccgttctgatcattgggcttcggcggcgggaccaagctgaccgtctatgtcaaccagctggcccctggtcactctgttccccacctctcgacgtgcgtcnctagagtcgggctggcaaagggcgcatagnnnn

SEQ ID NO: 435731 - DNA, 397 bp, Homo sapiens
  misc_feature: GZ8MTXP02IYJ1D.3.57.F02.1.454.CMB.2.raw
  modified_base (233)..(233): a, c, t, g, unknown or other
  modified_base (255)..(255): a, c, t, g, unknown or other
  modified_base (290)..(290): a, c, t, g, unknown or other
  modified_base (315)..(315): a, c, t, g, unknown or other
  modified_base (358)..(358): a, c, t, g, unknown or other
  modified_base (381)..(381): a, c, t, g, unknown or other
  modified_base (390)..(390): a, c, t, g, unknown or other
  modified_base (395)..(397): a, c, t, g, unknown or other
tcagagacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccaggtcgaggccgaggatgaggccnggacctattactggttcaggtntggggactagcgtctgatcgattgggcttcggcgngggccaagcctgacgtcctatcgtnacccaagtcctggcccttgggtcacctctgttccccacctccncccgagtgcgtctctgagcgggntggcaggcncatgnnn

SEQ ID NO: 435732 - DNA, 400 bp, Homo sapiens
  misc_feature: GZ8MTXP02JVGHC.3.57.F02.1.454.CMB.2.raw
  modified_base (309)..(309): a, c, t, g, unknown or other
  modified_base (395)..(400): a, c, t, g, unknown or other
tcagagacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcgggcggcgggaccaagctgaccgtctangtcaacccaggctggcccctcggtcactctcgttccccacctcctcgacgtgcgtctcgtgagcgggctgggcaagggcgcatagnnnnnn

SEQ ID NO: 435733 - DNA, 407 bp, Homo sapiens
  misc_feature: GZ8MTXP02F5J6V.3.57.F02.1.454.CMB.2.raw
  modified_base (401)..(407): a, c, t, g, unknown or other
tcagagacgcactccacgaccggtgctcgatttagctcgatatagttgggtttggggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatggaggccgactattactgtcaggtgtgggatagccgttctgatcagttgggtcttcggcggcggaccaagctgaccgtctatgtcaacccaggctggcccctcggtcactctcgttccccgccctcctcgacgtgccgtctctgacggcgggctgggacaaaggcgcaatagnnnnnnn

SEQ ID NO: 435734 - DNA, 450 bp, Homo sapiens
  misc_feature: GZ8MTXP02JXCQ7.3.57.F02.1.454.CMB.2.raw
  modified_base (269)..(269): a, c, t, g, unknown or other
  modified_base (407)..(407): a, c, t, g, unknown or other
  modified_base (415)..(450): a, c, t, g, unknown or other
tcagagacgcactccacgaccggtgctcgatttagctcgatatagttgggtttggggggtgtggtggtctccactcccgccttgacggggctgctatctgccttccaggccccctatcctggtcatcaattatgacagcgaccggccctcagggatcccctgagcgattctctggctccaactctgggaacacggccaccctgaccatcaccagggtcgaggccgaggatggaggccgactattactgtcaggtgtgggatagccgttngatcattggtctggcgcggacagctgaccgtctatgtccaacccgaaggctaggcccctggtctacgtctcgttaccccaccctccgtcgactcgccgtactcgtggacggccgggactgggaccaaaggggtcccanaagttagnnnnnnnnnnnnnnnnnnnnnnnnnnnnnnnnnnnn

SEQ ID NO: 435735 - DNA, 515 bp, Homo sapiens
  misc_feature: GZ8MTXP01BZOPB.38.25.C03.1.454.CMB.2.raw
  modified_base (310)..(310): a, c, t, g, unknown or other
  modified_base (451)..(451): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattactcgctggtaccagcagaaaccaggacagcctcctaagttgctcatttacngggcatctacccgggagtccggggtccctgaccgattcagcggcagcgggtctgagacagactttcactctcaccatcagcacgctgcaggctagaagatgtggctagtttattactgtcagcagtattatagtagtcctnaagtcgtttgggccggggacaaggtcgttaggagataacaaacgaactggtggctcgctaaccg

SEQ ID NO: 435736 - DNA, 507 bp, Homo sapiens
  misc_feature: GZ8MTXP01EI6A9.38.25.C03.1.454.CMB.2.raw
  modified_base (401)..(401): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgtttacacaggtccaaacaataagaattactcgctggtaccagcaagaaaccaggacagcctcctaaagttgctcatttactgggcatctacccgggagtccggggtccctgaccgattcagcggcagcgggtctgagacagatttcactctcaccatcagcagctgcagcngaagatgtggctagtttattactgtcagcagtatatagtagtctcaagtacgtttggccggggaccgaaagcttggagataacaaacgaactgtggctcgcaaccg

SEQ ID NO: 435737 - DNA, 508 bp, Homo sapiens
  misc_feature: GZ8MTXP01AHYX4.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatcgcacataatttccaagggcaagagtcatcatgaccacagacacatccacgagacactgcctacatggaactgacggaactgagatctgacgacgacggccttatattatgtgcgagagacaaattccttcttacataatacgaacgatggatgctttaa

SEQ ID NO: 435738 - DNA, 534 bp, Homo sapiens
  misc_feature: GZ8MTXP01CW78X.38.25.C03.1.454.CMB.2.raw
  modified_base (388)..(388): a, c, t, g, unknown or other
tcagtcgatcacgtcacgaccggtgctcgatttagtagtgtagatttgggtttggggacccaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacactttttagcagttatggtgtcagctgggtgcgacaggcccctggacaagggcttgagtggatgggatggatcagcacttacaatggaaacacaaagtatagcacataaatttccaaagggcaagagtcatcatgacanagacacatccacgagacactgcctacatggaactgaggggaacctgagatctgacgacacggtccttaatattattgtgcgagagactaaatttccttaccttacattaacttaacgaacgtaatagggttaaagtgttcttttaa

SEQ ID NO: 435739 - DNA, 643 bp, Homo sapiens
  misc_feature: GZ8MTXP01ELPTX.38.25.C03.1.454.CMB.2.raw
  modified_base (437)..(437): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacaagggcttgagtggatgggatggatcagcacttacaatggaaacacaaagtatacgcaacgaataaatttcccgaaaggggtcaaggagtcattcatagaccaacagacacactaccaacgacgacaacgttgaccctaanacgtacggaaacgtaggaacggggtaacgtaggaacgtacgttacgtacggaaccgaaccgtaaccgggttacctttaagttaagtttacgttggtaacggaacggttaaggtaaacgttaaacgttaaacgtttaccccttaccgttaaacttactttaacgttaacgtaacgtaagtacggttaagttcgtttaacgttttaag

SEQ ID NO: 435740 - DNA, 526 bp, Homo sapiens
  misc_feature: GZ8MTXP01DPL7X.38.25.C03.1.454.CMB.2.raw
  modified_base (381)..(381): a, c, t, g, unknown or other
tcagtcgatcacgtcacgaccggtgctcgatttagtagtgtagatttgggtttggggacccaaaaccacacccctcattgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacagggcttgagtggatgggatggatcagcacttacaatggaaacacaaagtatgacacataattccagggcagagtcatcatgaccanagacacatccacgagcactgcctacataggaactgggaacggaacctgagatctagaacgtacacggtccttatattattgtgcgtagagtaactaaattcccttccttaacaattaattaaccgatattaggtaagttgttaac

SEQ ID NO: 435741 - DNA, 510 bp, Homo sapiens
  misc_feature: GZ8MTXP01D0DMI.38.25.C03.1.454.CMB.2.raw
  modified_base (311)..(311): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattactcgctggtaccagcagaaaccaggacagcctcctaagttgctcatttacngggcatctacccgggagtcccggggtcctgaccgattcagcggcaggcgggtctgagacagatttcactctcaccatcagcagcctagcaggctgaagatgtggctagtttattactgtcagcagtattatagtagtcctcaagtactttgggccggggttacaaggcttaggagatcaaacgaactgtggctgcaacc

SEQ ID NO: 435742 - DNA, 509 bp, Homo sapiens
  misc_feature: GZ8MTXP01BJYHN.38.25.C03.1.454.CMB.2.raw
  modified_base (431)..(431): a, c, t, g, unknown or other
  modified_base (450)..(450): a, c, t, g, unknown or other
  modified_base (482)..(482): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttacacaggtccaaacaataaagaattactcgctggaccagcaagaaaccaggacagcctcctaagttgctcatttactgggcatcgtacccgggagtccgggtcctgaccgacttcagcgcaggcgggtctgagacagatttcactctcacatcagcagctgcagctagaagatgtggctagtttattactgtcagntagtattatagtagtcctnaagtcgtttgggccggggacaaggcgttgganataacaaacgtaactggtgctgcgaac

SEQ ID NO: 435743 - DNA, 527 bp, Homo sapiens
  misc_feature: GZ8MTXP01BQND6.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactccccaggttcaattggtgcagtctggagctgcggtgaagaggcctggggcctcagtgaacgtctctgcaaggcttctggttacacttttagcagttatggtgtcagctgggtgcgacaggcccctggacaagggcttgagtggatggggatgggatcagcacttacaataggaaacacaaagtatgcacataattccaagggcaagagtcatcatgaccacagacacataccacgagacaactcgacctacatggaactgacgggaactgagatcgtgacgacacggtccttatacttatgtgcgagagactaaacttccttacttcataattacgaacgtatggttaagtgttcttttaa

SEQ ID NO: 435744 - DNA, 513 bp, Homo sapiens
  misc_feature: GZ8MTXP01B2Q63.38.25.C03.1.454.CMB.2.raw
  modified_base (383)..(383): a, c, t, g, unknown or other
tcagtcgatcacgtcacgaccggtgctcgatttagtagtgtagatttgggtttggggacccaaaaccacacccctcattgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtactgacacataatttccagggcagagtcatcatgacanagacacatccacgagcactgcctacatggaactgggaggaacctgagatctgacgacacggtccttatattatgtgcgagagaactaaattccttcttacaatattaacgacgattaggtaagttgtaac

SEQ ID NO: 435745 - DNA, 549 bp, Homo sapiens
  misc_feature: GZ8MTXP01DLKGF.38.25.C03.1.454.CMB.2.raw
  modified_base (394)..(394): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacacttttagcagttatggtgtcagctgggtgcgacaggcccctggacaagggcttgagtggatgggatggatcagcactttacaataggaaacacaaagtatgacacattaactttccaaggacaagagtcaatcatcgaccanagacacatccacgagacactcgacctacatcggaaactcggaaggggaaccctgaagactactgacgacacggtccttaatattattgtgcgagacgactaaacttcccttacttacaattaattaacgaacgtatggttaattgttcttttaac

SEQ ID NO: 435746 - DNA, 552 bp, Homo sapiens
  misc_feature: GZ8MTXP01DSJFZ.38.25.C03.1.454.CMB.2.raw
  modified_base (484)..(484): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaacacaaaagtatgacactaataaatttccaaagggcaagagtcatcaatcgaaccacagacacatccaacgagacactcgacctacatggaaactgaaggggaaacctgaagatcgtagacgacaacggccttaatattattgtgngagacgaactaaaacttcccttaccttacattaattaacgaacgtataggaaagttgttaacttttaa

SEQ ID NO: 435747 - DNA, 561 bp, Homo sapiens
  misc_feature: GZ8MTXP01ADKGO.38.25.C03.1.454.CMB.2.raw
  modified_base (345)..(345): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgagcgagaggccaccatcaactgcaagtccagccagagtctttgtcagctcaagaatatgagtcgtagcttggtaccagcagaaagcacgacagtcccctaagttgctctatttattggtactatctacgtcggtcgtccccggtcctgacgtntcgaagcgcagcgatcgtgggacagtacttcactctacacatcacgcacgcctgacgtagacgtagaaggtagttgggtcgtacgtttaagttttacttaccgtagttaccacgtactaaattatttagtcggttacttccgtcggccttcgtaacggtttccgggacgggttaacggaaccgtaagggtcggagtacttaccgaagccgttaagg

SEQ ID NO: 435748 - DNA, 506 bp, Homo sapiens
  misc_feature: GZ8MTXP01C05ND.38.25.C03.1.454.CMB.2.raw
  modified_base (388)..(388): a, c, t, g, unknown or other
  modified_base (402)..(402): a, c, t, g, unknown or other
  modified_base (439)..(439): a, c, t, g, unknown or other
  modified_base (465)..(465): a, c, t, g, unknown or other
  modified_base (490)..(490): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggatgggatggatcagcactttacaatggaaacacaaagtatgacacataattccaagggcaagagtcatcatgaccanagacacatccagancactgacctaacatagaactagagggaacctagaganactgacgacacgacctatatatgtgngagagacaatacttcttcataatanaacatgagtgctttaa

SEQ ID NO: 435749 - DNA, 534 bp, Homo sapiens
  misc_feature: GZ8MTXP01BAVQI.38.25.C03.1.454.CMB.2.raw
  modified_base (471)..(471): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatcgacacataatttccgaaagggtcaagagtcatcatcgacacagacacatcacgagcactgacctacatcggaactgaacggggaacctgagatctgacgacacggtcttaagtattagttgngtacgagacgactaaattccttacttacactaattacgaacgtagtggaagtgttcttttaag

SEQ ID NO: 435750 - DNA, 519 bp, Homo sapiens
  misc_feature: GZ8MTXP01DLIJT.38.25.C03.1.454.CMB.2.raw
  modified_base (370)..(370): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcattacaatggaaacacaaagtatcgacacataattccaaagggcngagtcatcatgacacagacacatccagagacactgacctacatggaactgaggggaacctgagatctgacgacacggccttatattatgtgcgagagactaaattccttacgttcattaattacgaacgtataggagtcgttcttttaa

SEQ ID NO: 435751 - DNA, 624 bp, Homo sapiens
  misc_feature: GZ8MTXP01AU0OD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggatgggatggatcagcacttacaatggaaacacaaagtatcgacacataactttccgaaagggtcaagagtcagtcatcgacacagacacatccacgagacactcgacctaacagtacggaactaggaacggggtaaaccgtggaaacgacttccgtaggaacccgaacgtaaccgggtcctttaaagttaacgtttaaagtttggtaaggtacgaaggtaaacgaacttaaaacgtttcccttaacccgtttacaacgttaacttaacggtaaccgtattacggggttaaacgttggttaaccgttttttaag

SEQ ID NO: 435752 - DNA, 525 bp, Homo sapiens
  misc_feature: GZ8MTXP01EFKYE.38.25.C03.1.454.CMB.2.raw
  modified_base (384)..(384): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataatttccaagggcaagagtcatcatgacanagacacatccacgagacactgacctacatggaactgaggggaaacctgaagatctgacgacacggccttaatattatgtgcgagacgaacaaacttccttaccttacataattaacgaagtaatggttaatgttcttttaa

SEQ ID NO: 435753 - DNA, 525 bp, Homo sapiens
  misc_feature: GZ8MTXP01BE196.38.25.C03.1.454.CMB.2.raw
  modified_base (372)..(372): a, c, t, g, unknown or other
  modified_base (387)..(387): a, c, t, g, unknown or other
  modified_base (469)..(469): a, c, t, g, unknown or other
  modified_base (475)..(475): a, c, t, g, unknown or other
  modified_base (493)..(493): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggatgggatggatcagcacttacaagtggaaacacaaagtatgacacataattccgaagggcngagtcatcatgacanagacacatccagagcaactcgacctacataggaactggacgggaacctgacgatcagacgacacggtcttatattatgtcgngagganactaaattccttacttanacttaattacgaacgtatggaatgttctttaa

SEQ ID NO: 435754 - DNA, 534 bp, Homo sapiens
  misc_feature: GZ8MTXP01EX2WW.38.25.C03.1.454.CMB.2.raw
  modified_base (386)..(386): a, c, t, g, unknown or other
  modified_base (439)..(439): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaatggaaacacaaagtatgacacataattccaaagggcaagagtcatcatgacanagacacatccagagcactcgcctacatggaactgaaggggaacctgagatcgngacgtacacggtccttaagtattagtgtgacggagaagactaaattcccttaccttacattaagttacgaacgtagtggaaagtgttcgttttaa

SEQ ID NO: 435755 - DNA, 676 bp, Homo sapiens
  misc_feature: GZ8MTXP01A7IG9.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacacggcccctggacgaaagggcttggagtggatgggatggatcagcacttacaataggaaacacaaagtatcgacacataactttccaaaggacaagagtcatcatcgaaccacagacacactccaacgagaccaactcgacctacaagtacgggaaactacggaacggggaaacccgttaggaacggtacttaccgtacggaacccgtaaccgtaacccggggtacccttttaaattaacgttttaacgtttgggtaacgaaccgggttaaaggtaaacgttaaaccgtaaaaacgttttccccttaacccgttttaaacaactttaaacgttaaccggtaaaccgttaaggttaggggttaaacgtttcggtttaaccttttttaaacg

SEQ ID NO: 435756 - DNA, 526 bp, Homo sapiens
  misc_feature: GZ8MTXP01CLA2L.38.25.C03.1.454.CMB.2.raw
  modified_base (387)..(387): a, c, t, g, unknown or other
  modified_base (520)..(520): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactccccaggttcaattggtgcagtctggagctgcggtgaagaggcctgggggcctcagtgaacgtctcctgcaaggcttctggttacactttttagcagttatggtgtcaggctgggtgcgacaggcccctgggacaaggggcttggagtggatgggatggatcagcacttacaatggaaacacaaagtatgacacataatttccaaagggtcaagagtcatnatgaccacagacacatcacgagacactgacctacataggaactgaggggaacctgagatcgtagacgacacggcttatattattgtgtcgagagactaaattccttacttcattaatacgaacgatggatcgntttaac

SEQ ID NO: 435757 - DNA, 767 bp, Homo sapiens
  misc_feature: GZ8MTXP01C79MF.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacacggcccctggacaagggcttgagtggatgggatggatcgagcactttaacaaataggaaaacacaaaagtatacgacaactaattaaacgtttacccgaaagggggtaccaaggtaaacgttacaaacttacctaaagtacgggaaaccccaaaccaagaaaccaaccgaactaccccgaaacgggaacgaccaaaccttcgaacccttaaaccaacgttagggaaaaccttgggaaacggggggaaaaccccttggaaacggtacttaccgttaacggaacccgtaaaccgaaacccggggttaccctttaaaggttaacttttaaacgttgggttaagaaccggttaaagggaaacgttaaacccgttaaaaactttccccgtttaacccgtttaaaccttaaattttaaacgttaaacccggtaaacgggttaaacttacgggggttaaaacgtttggttaacctttttttaaacgg

SEQ ID NO: 435758 - DNA, 518 bp, Homo sapiens
  misc_feature: GZ8MTXP01BO0AD.38.25.C03.1.454.CMB.2.raw
  modified_base (474)..(474): a, c, t, g, unknown or other
  modified_base (503)..(503): a, c, t, g, unknown or other
tcagtcgatcacgtcacgaccggtgctcgatttagtagtgtagatttgggtttggggacccaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaaggggcttgagtggatgggatggatcagcacttacaatggaaacacaaagtatcgacacataaatttccaagggcaagagtcatcatgaccacagacacatccacgagcactgcctacatggaactgaggggaacctgacgatctgacgacacggcctttagattatgtgcgagaganaaacttccttaccttacataattacgaanatggaatgcttttaa

SEQ ID NO: 435759 - DNA, 534 bp, Homo sapiens
  misc_feature: GZ8MTXP01CS0JL.38.25.C03.1.454.CMB.2.raw
  modified_base (446)..(446): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacactttttagcagttatggtgtcagctgggtgcgacaggcccctggacaagggcttgagtggagtgggatggatcagcatttacaatggaaacacaaagtatagcacataaactttccgaaagggcaagagtcaatcatgaccacagacacatccacgagcactgacctacataggaactgagggaacctgagatcngacgacgacggtccttatattatgtgcgagtagactaaacttccttaccttacattaattacgaacgtatggaagttgttcttttaag

SEQ ID NO: 435760 - DNA, 553 bp, Homo sapiens
  misc_feature: GZ8MTXP01BQUR4.38.25.C03.1.454.CMB.2.raw
  modified_base (304)..(304): a, c, t, g, unknown or other
  modified_base (409)..(409): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttacacaggtccaaacaataaagaattactcgctggtaccagcaagaaaccaggacagcctacctaagttnctcatttactgggcatcgtacccgggagtcccggggtccctgaccgattcgagcggcacggcgggtctgagacagtactttcactctcaccatcagcagcctgcnggctgaagatgtggctagtttattactgtcagctagtattatagtacgtcctgaagttacgttttcggggacccgggggaacctaaaggtccgttagggagttacgtaacgaaacgaacttaggcgggttctcggccgtaaccg

SEQ ID NO: 435761 - DNA, 574 bp, Homo sapiens
  misc_feature: GZ8MTXP01DW2PG.38.25.C03.1.454.CMB.2.raw
  modified_base (440)..(440): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttatggtgtcagtcgtgggtgcgacgacggcccctaggacgaagggtcttggagtggagtgggatggatcgagcactttacaagtaggaaacaacaaagtatgacactattaacttccgaagggcaaggagtcatacatcgacacagacacactaccacgagacactgaccctaanacgtaggaaacctggaacggggaacctggaacgtatcagacgacacggtccttaatacttatgtgacgaggacaactaaacttccttacttacttattaagtacgaagtatggttaacgttgttaacttttaag

SEQ ID NO: 435762 - DNA, 515 bp, Homo sapiens
  misc_feature: GZ8MTXP01BPIEU.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacactttttagcagttatggtgtcagctgggtgcgacaggcccctggacaagggcttgagtggatgggatggatcagcacttacaatggaaacacaaagtatcgcacataatttccaagggcaagagtcatcatgaccacagacacatccagagcactgcctacatggaactgaggggaacctgagatctgacgacacggccttatattatgtgcgagagactaaattccttaccttacataattacgaacgatggaatgcttttaa

SEQ ID NO: 435763 - DNA, 525 bp, Homo sapiens
  misc_feature: GZ8MTXP01AZ3R8.38.25.C03.1.454.CMB.2.raw
  modified_base (412)..(412): a, c, t, g, unknown or other
  modified_base (495)..(495): a, c, t, g, unknown or other
  modified_base (519)..(519): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacacttttagcagttatggtgtcagctgggtgcgacaggccccctggaccaagggcttgagtggatgggatggatcagcacttacaatggaaacacaaagtatgacacataattccaagggcaagatcatcatgacacagacacatccacgagacactgcctanatggaactgacggggaacctgagatactgacgacacggtccttagtaattatgtaagcgagagaactaaattccttaccttanataatacgaacgatggaagtgttntttaac

SEQ ID NO: 435764 - DNA, 548 bp, Homo sapiens
  misc_feature: GZ8MTXP01A8XMP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacagggcttgagtggatgggatggatcagcacttacaataggaaacacaaagtatagacacaataattccgaaagggcaagagtcatcatgacacagacacatccaacgagtacactcgacctaacagtacggaactagaacggggaacctggaacgaattcagaacgacaacggtccttaatattaattggtgacgaggacaactaaacttccttacttacattaacttacgaacgtatggaatgttctttaa

SEQ ID NO: 435765 - DNA, 639 bp, Homo sapiens
  misc_feature: GZ8MTXP01A7O8O.38.25.C03.1.454.CMB.2.raw
  modified_base (311)..(311): a, c, t, g, unknown or other
  modified_base (326)..(326): a, c, t, g, unknown or other
  modified_base (343)..(343): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacgatcaactgcaagtccagccagagtgtttacacaggtccaacaataagaattactcgctggtaccagtcagaaaccaggacagcctactaagttgctcatttacngggcatctaccgggngtccgggtcctgaccgnttcagcggcacggcgggtctgagacagtacttcactctacacctatcgagtcacgcctgactaggctaggaacgagttcgtaggaccgttaagttttacgttaacgtcggttacaaggtcctaaggttaactttaacgtaacgtttacgttaccccgttgtaaaccggtttaccggtttttacgggggacccgggggttaaacctaacgggtccgttacgggaacgttaaccgttaaccgaaaaaccggttaacgttacgggtacggttaccgtaacgttaacccgttaaacccgg

SEQ ID NO: 435766 - DNA, 652 bp, Homo sapiens
  misc_feature: GZ8MTXP01B9EUI.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcaactttaacaagtaggaaacacaaagtatacggacaacaattaaactttcccaaagggggtaccaaggagttacaattcgaatacgaacccaacagaaccaactactaccaacgagaccaacttcgaccctaacagtacggaaacttcggaacggggtaaccttaggaacggactacgtacggaccggaacgtaaccgggtacccttaagttaatttacttggtaagacggttagtaaacggttaactaaaacttcccttaacccgtttaacttaacgtttaacttaacgtaacggtaatacgggttaacgttgttaacctttttaag

SEQ ID NO: 435767 - DNA, 547 bp, Homo sapiens
  misc_feature: GZ8MTXP01EQF5F.38.25.C03.1.454.CMB.2.raw
  modified_base (319)..(319): a, c, t, g, unknown or other
  modified_base (423)..(423): a, c, t, g, unknown or other
  modified_base (450)..(450): a, c, t, g, unknown or other
  modified_base (534)..(534): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagtgtttacacaggtaccaaacaataagaattactcgctggtaaccagcaagaaaccaggacagcctacctaagttgctactatttacgngggcacgtccgtacccggggagtcccggggtcctgaccgtatcgagcggcaggcgggtctggagacagtactttcactctcacatcagcagctgcagctagagntagtggactagtttattactgtacagngtagttattatagtacgtctcgtaagttacgtttgggaccggggttaccgaagtcgttaggagactaacgaaacgtaacgtggnggactcgctaacc

SEQ ID NO: 435768 - DNA, 510 bp, Homo sapiens
  misc_feature: GZ8MTXP01AE5GD.38.25.C03.1.454.CMB.2.raw
  modified_base (454)..(454): a, c, t, g, unknown or other
  modified_base (482)..(482): a, c, t, g, unknown or other
  modified_base (497)..(497): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattactcgctggtaccagcagaaaccaggacagcctcctaagttgctcatttactgggcatccgtacccgggagtcccggggtcctgaccgacttcagcggcagcgggtctgagacagatttcactctcaccatcagcagcctgcaggctagagagtgtggcgtagtttattactgtcagcagtatatagtagtctngtacgtttgggccgggacgaagcttggngataacaagaactgnggactcgctaacc

SEQ ID NO: 435769 - DNA, 625 bp, Homo sapiens
  misc_feature: GZ8MTXP01DMW4M.38.25.C03.1.454.CMB.2.raw
  modified_base (436)..(436): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacacggcccctggacgaagggcttggagtggatgggatggatcagcaacttacaagtaggaaacacaaaagtatacgacaactaattaactttacccgaaagggcaaggagtaccaatcaatcgaaaccaacagaacacaactcccaacgganaccactacgaccctaacaagtacggaaacctaggaacggggaaaccctggaacgtactacgagaaccgaacgtaccggtacctttataagtttattggtaagacgaaggtaacgttaactaaaactttcccttaccgttaacaattaacgttaacgaacgtaagtagggttattcgttccgtttttaag

SEQ ID NO: 435770 - DNA, 758 bp, Homo sapiens
  misc_feature: GZ8MTXP01DPQ3D.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacacggcccctggacaagggcttgagtggagtgggatggatcgagcactttaacaagtaggaaaacaacgaaagtatacgacaactaattaaactttacccgaaaggggtaccaaggtaacgtaccaaagttaccaagtacgaaacccaacaacgaaccaacctaactacccgaacggaacgaccctaacgttacgaccccttaaacgaacgttaacgggaaaccgttacgggaaacggggtaaacccgttaggaaacggtaacttaccgtacggaaaccggtaaaccgtaacccggtaccttttaaagttaactttaagtttgggttaacgaacgggaaaggtaaacggttaaacccgtaaaaaccgttttccccttaacccgttttaaaccttaaactttaaacgtttaaacccggaaacggttaacggttaacggggttaaacggtttcggtttaacctttttttaaaccg

SEQ ID NO: 435771 - DNA, 684 bp, Homo sapiens
  misc_feature: GZ8MTXP01CV8D6.38.25.C03.1.454.CMB.2.raw
  modified_base (308)..(308): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaaggcttgagnggatgggatggatcagcaactttacaaagtggaaaacacgaaaagtatacggacactaattaaatttcccgaaaaggggacaagacggttaccaattacgaatcgaaacccaacacgaacaaacgactcccaaacggaacgacctaacttacggaccccttaaacgacgtaacggaaacgtaggaaacggggtaaaccgtaggaaacgtacgtaccgtaacgaaccggtaacgtaaccggttacctttaaagttacgtttacgttggtaacggaacgttaagtaaacgttaaaccgttaaaccttcccttacgttaaacgttaacttaacgttaaacgtaacgtaagttacggttaacgttcgttaacgttttaag

SEQ ID NO: 435772 - DNA, 602 bp, Homo sapiens
  misc_feature: GZ8MTXP01C8JOO.38.25.C03.1.454.CMB.2.raw
  modified_base (317)..(317): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaaacaataagaattactcgctggtaccagcaagaaaccaggacagccctacctaagttgctctatttacgngggcagtccgacccgggagtcccggggtccctggaccgtacttccgagccggcaggcgggtctggacgacagtacttcactcacacatcagcagcctagcgaggctagaagtagtggtgtacgtaggttttattacgtgtactagactaagttattaagttagtacgtaccttgtaacggttaccggttttcgggggacccggggaaccgtaaggtaccgttaggaacgttaacgtaacgaaaaccgtaacgttcgggtacggttaccgttcggaacctaacccg

SEQ ID NO: 435773 - DNA, 585 bp, Homo sapiens
  misc_feature: GZ8MTXP01ERQ3S.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacacggcccctggacaagggcttgagtggatgggatggatcagcaactttacaaagtaggaaaacacaaaagtatacgacaactaataaactttcccgaaaggggcaaggatacatcaatcgacacagacacatccacgagacactcgacctacataggaactggaacggggaacctgaagtactcgtgaacgacacggtacttaattattattggtgacgaagtaacgttaaactaaacttcccttaccttattaacttaataccgtaacgagttagggaagttcgttaacgtttttaag

SEQ ID NO: 435774 - DNA, 534 bp, Homo sapiens
  misc_feature: GZ8MTXP01DOCBH.38.25.C03.1.454.CMB.2.raw
  modified_base (480)..(480): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacactttttagcagttatggtgtcagctgggtgcgacaggcccctggacaagggcttgagtggatgggatggatcagcacttacaatggaaacacaaagtatcgacacataatttccaagggcaagagtcaatcatcgaccacagacacatcacgagacactgacctacataggaactgaaggggaacctgagaatcgtgacgacacggtccttaatattatgtgcgagganactaaatccttacttacttataacttagaacgtagtggttaagttgttcgttaa

SEQ ID NO: 435775 - DNA, 678 bp, Homo sapiens
  misc_feature: GZ8MTXP01DVYN2.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtgggggcctcagtgaacgtctcctgcaaggcttctggttacacttttagctagttatggtgtcagcgtgggtgcgacacggcccctggacaagggcttgagtggagtggatggatcagcaacttaacaaagtaggaaaacaacaaaagtatagacaaactaattaaactttccgaaaggggacaaggtacgtacaaattaccaatacggaacccaaacaacgaacaacctaactacccgaaacgaagtaccaacgttcgaccctaacgaagttacgggaaactggaaacgggggtaaacctgggaaagtactacgtacggaaccgaaccgtaaccggtacctttaagttaatttacgttggtaagacggaaagtaaacgttaaactaaaactttcccttaccttaaacttaattaaatttaacccgaacgtaagttacgggttaatttaacggttaaccgtttttaag

SEQ ID NO: 435776 - DNA, 651 bp, Homo sapiens
  misc_feature: GZ8MTXP01D7RWK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagcgtgggtgcgacacggcccctggacaagggcttgagtggagtgggatggatcagcacttaacaagtaggaaaacacaaagtatacgacaactaattaaactttcccgaaaggggtaccaaggagttaccaattaccaagtcggaaacccaacgaacgaacaacactacccgaaacgacgacctaacgtcgacccttaacaagttacgggaaaccttgggaaacggggtaaaccgttggaaacgtatacgtacgaaccgaacgtaaccggtaccttaattagtttaatggtaacgcgaaagtacgttaaactaaactttcccttacttaacattaacgtaacgtaagtagtaggttaagttcgttaacgttttaacg

SEQ ID NO: 435777 - DNA, 518 bp, Homo sapiens
  misc_feature: GZ8MTXP01BPOZ6.38.25.C03.1.454.CMB.2.raw
  modified_base (312)..(312): a, c, t, g, unknown or other
  modified_base (425)..(425): a, c, t, g, unknown or other
  modified_base (429)..(429): a, c, t, g, unknown or other
  modified_base (437)..(437): a, c, t, g, unknown or other
  modified_base (484)..(484): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattactcgctggtaccagcaagaaaccaggacagcctccaaagttgctcatttacngggcatctaccgggagtccgggcctcgacgacttcagcggcagcgggtctgagacagattctactctcaccatcagcagctgcaggctgaagatgtggcagtttattactgtnacgnagtaattntagtagtctcaagtacgttttcgggccggggaccgaagtacgttggngacttaacaaacgaactcgtgggctcgcgaaccc

SEQ ID NO: 435778 - DNA, 549 bp, Homo sapiens
  misc_feature: GZ8MTXP01D03W0.38.25.C03.1.454.CMB.2.raw
  modified_base (481)..(481): a, c, t, g, unknown or other
  modified_base (513)..(513): a, c, t, g, unknown or other
  modified_base (527)..(527): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacaggcccctggacaagggcttgagtggatgggatggatcagcactttacaataggaaacacaaagtatacgacacataatttcccaaagggcaagagtcatcatcgaccacagacacactccaacgagacactgcctacataggaactggaagggtaacctgagatctgacgacgacggtccttaagtattattgngtacgagaacgaactaaacttccttaccttanacttaatacgtaanagtaggttattgttcttttaag

SEQ ID NO: 435779 - DNA, 523 bp, Homo sapiens
  misc_feature: GZ8MTXP01B85ZL.38.25.C03.1.454.CMB.2.raw
  modified_base (497)..(497): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggcttggagtggagtgggatggatcagcacttacaatggaaacacaaagtatcgacacataacttccaaagggcaagagtacatcatgacacagacacatcacgagacactgcctacataggaactgaggaactgagatctgacgacaccggtccttaatagttatgtaagacgagagactaaacttcttaccttanataatagaacgatgagtgttctttaa

SEQ ID NO: 435780 - DNA, 548 bp, Homo sapiens
  misc_feature: GZ8MTXP01ED9C0.38.25.C03.1.454.CMB.2.raw
  modified_base (430)..(430): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttaacaataggaaaacacaaaagtatacgacaacaattaaatttcccaaaggggtccaaggagtcaatcatgaccacagacacatccagagacactgacctanactggaactgacggggaacctgagatctagacgacgacggtcttatattatgtgcgagagttactaaacttccttacttacattaattacgaacgtagtaggaagttcgttcttttaa

SEQ ID NO: 435781 - DNA, 552 bp, Homo sapiens
  misc_feature: GZ8MTXP01BQSIT.38.25.C03.1.454.CMB.2.raw
  modified_base (349)..(349): a, c, t, g, unknown or other
  modified_base (426)..(426): a, c, t, g, unknown or other
  modified_base (465)..(465): a, c, t, g, unknown or other
  modified_base (489)..(489): a, c, t, g, unknown or other
  modified_base (502)..(502): a, c, t, g, unknown or other
  modified_base (523)..(523): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgaggccccctggacaagggcttgagtggagtgggatggactcgagcacttacaagtaggaaacanaaagtatcgacacataaacttccaaaggggcaagagtacatacaatcgaacacacgacacacaccacgagcaacgtnacctacataggaactgacggggaaactgaagactaccgngaacgacacggtccttaagtattntgtgacgaggtanaactaaacttccttaccttanataattacggaatgtaggattgcttttaa

SEQ ID NO: 435782 - DNA, 550 bp, Homo sapiens
  misc_feature: GZ8MTXP01EVKCW.38.25.C03.1.454.CMB.2.raw
  modified_base (452)..(452): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttggagtggatgggatggatcagcacttacaatggaaacacaaagtatgacacataattccaagggcaagagtcatcatgaccacagacacatccacgagacaactgacctaacataggaaacctggaacgggaaaccgtgaagtactacncgaacgacctacgggtccttaatatttatgtcgtacgagtagaactaaattcccttacttacattaagttacgaacgtagtgggaatcgttcttttaa

SEQ ID NO: 435783 - DNA, 646 bp, Homo sapiens
  misc_feature: GZ8MTXP01AOQSP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacactataattccaagggcaagagtcatcatcgacacagacacatccaacgagacaactcgaccctaacaagttagggaaaccttgggaacgggggaaacccttaggggaaacgtacgttacgtacggaaccgtaaccgtaaccgggttacctttaagttaagtttacgttaggtaacggtaacgttaaacggtaaacgttaaaccgttaaactttacccttaccgtttaaacttaacgttaacgttaaaccggtaacgtaacgttaggggttaacgttcgtttaaccgttttaacg

SEQ ID NO: 435784 - DNA, 641 bp, Homo sapiens
  misc_feature: GZ8MTXP01D5PH1.38.25.C03.1.454.CMB.2.raw
  modified_base (317)..(317): a, c, t, g, unknown or other
  modified_base (433)..(433): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgttctggatctctggtgcctacggggacatcgtgatgacccagtctccagactccctggctgtgtctctgggcgagagggccaccatcaactgcaagtccagccagagtgttttacacaggtaccaaacaaataagaattactcgcttggaccagcagaaaccagacagcctactaaagttgctctaatttacgngggacatcccgtaccccgggggtacggttcccggggtccctggacccgattcccgaaggcggcgacggtccggggtctaggcgacagtactttccacttctcaccatcagcagccngacgagctagaagagtgtacgtacttaggtttattacgtcgtacgagtacgttagttaattaagttacgttacgttaccgtacgtaacggtttaaccgggtttaccggggacccggggtaaacgttaaggtacggtaagggaacgttaacgttaaaccggtaaaacgtacgttcgggtacggtacgttaccgtaaccttaacgtaacg

SEQ ID NO: 435785 - DNA, 586 bp, Homo sapiens
  misc_feature: GZ8MTXP01AS7SU.38.25.C03.1.454.CMB.2.raw
  modified_base (434)..(434): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgacggcccctggacgaagggcttggagtggagtgggatggatcaggctacttaacgaagtaggaaaacacgaaagtatcgacacataacgtttccaaaggggcaagagtcatcatagaccacagacacataccacgagcactcgacctanacgtaggaactggaacggggaacctgaacgtatcgtagaccgacacggtaccttaagtatttagtcggtaagacgttaagaacgacctaaactttcccttaccgttacaattaacgttacgaacgtagtaggttagttgttaacgttttaac

SEQ ID NO: 435786 - DNA, 615 bp, Homo sapiens
  misc_feature: GZ8MTXP01ELPV1.38.25.C03.1.454.CMB.2.raw
tcagtcgatcacgtcacgaccggtgctcgatttagtagtgtagatttgggtttggggaaccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggagtgggatggatcagcactttaacaataggaaacacaaaagtatacgacaactaataaatttcccgaaaggggtacaaggtaagttcaattcaatacgaaccaacacgacacactaccaacgacgaccaactgacctaacagtaggaaacctaggaacgggggaacctagggaatacgtccgtagaacccgacgtaaccggtaccttaattagttaagttggtaagacgttaagacgttaaactaaactttcccttaccgttaacattaatacgaacgtagtagggaagttgttaacttttaacg

SEQ ID NO: 435787 - DNA, 652 bp, Homo sapiens
  misc_feature: GZ8MTXP01D9R9U.38.25.C03.1.454.CMB.2.raw
  modified_base (348)..(348): a, c, t, g, unknown or other
  modified_base (441)..(441): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggccctggacgaagggcttggagtggagtgggatggatcagcacttacaagtaggaaacanaaagtatcgacacaattaattcccgaaagggacaaggagtcaatacatacgaaccaacacgacacacaccaacgacgaccactcgaccctaanacgtacggaaactacggaaacgggggaaacccgttaggaacgtacgtaccgtaacggaaccgtaaccgtaaccggttacctttaaattacgtttaagttggtaaggaaccggttaaggtaaacgttaaaccgtaaactttcccttaacccgtttaacaatttaacgtttaacggaacgtagtagggttaagttcggtttaacctttttaag

SEQ ID NO: 435788 - DNA, 613 bp, Homo sapiens
  misc_feature: GZ8MTXP01DR3PU.38.25.C03.1.454.CMB.2.raw
  modified_base (439)..(439): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttacacaggtaccaaacaataagaattactcgctggtaccagcaagaaaccaggacagccctacctaaagttgctctaatttacgtgggactatccgtacccggggagttcccggggtccctgacccgtattccgagcggcaggccgggtctgagacagtattcactctacaccataccagctacgcctagcacggctagaagngtagtcggacgttaaggttttattaaccgtgtaccgagtactaagttaattagtaggttaacgttcctacgtaacgtacggttttccggggacccgggggttaccgaaacggtcgttagggaggttaacttaaccgaaaacggtaaccgttggacggttcttcgccgtaacccg

SEQ ID NO: 435789 - DNA, 612 bp, Homo sapiens
  misc_feature: GZ8MTXP01CXWEE.38.25.C03.1.454.CMB.2.raw
  modified_base (551)..(551): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttgagtggagtgggatggatcagcatttaacaagtaggaaacaacaaagtatacggacaactaataaatttcccgaaaggggaccaaggtaacgttccaaattaccaagttacgaaacccaaacagaaccaacaactaccaacgagaccaactcgaccctaacgatacggaaactgaacggggaaacctagagactcgtacgaaccgacgtaaccggtccttaaagtacttaatcggtgacgaagganaactaaacttccttacgttacatttaataccgaagtataggttaagtcgttaacttttaag

SEQ ID NO: 435790 - DNA, 606 bp, Homo sapiens
  misc_feature: GZ8MTXP01BKUE5.38.25.C03.1.454.CMB.2.raw
  modified_base (328)..(328): a, c, t, g, unknown or other
  modified_base (588)..(588): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgacaagtccagccagtagtgtttacacaggtaccaaacaataagaattactcgctaggtaccagacaacgaaaccgaggacacgaccctactaagtcgctactatttacgngggactacgttccggtaccccgggggtacgtcccgggggtccctggaccgtacttcgacggcggcgagggccgggtctggacacgtagtactttcactctaccactatcgagcacgccgtaggcaggactagaaagtgttggtacggtacttaaggttttactaccgtgtacgagtctaagttattagtgtactcctagaacgtttacggttcgggggaccgggaactaaggtcttagggaacttacgtaacaaacggtntggtcgactcgcctaacg

SEQ ID NO: 435791 - DNA, 682 bp, Homo sapiens
  misc_feature: GZ8MTXP01BH47H.38.25.C03.1.454.CMB.2.raw
  modified_base (326)..(326): a, c, t, g, unknown or other
  modified_base (403)..(403): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatccaactgacaagtccagccagagttgtttacacaggtaccaaacaataagaattactcgctaggtaccagcaagaaaccaggacagcctacctaaagttcgctactatttacgngggactacgtaccggtacccgggacggttcccgggtcctacggaccgtacttcgacggtcggcgaggtccgggttcnggacgacgagttacttacactctaccaccatacgagaccgtacgccgtagacgaggtctaaggaaagtgttggtacgggtacgtttaagtttttaataccgtcgggtactaaggtacttaaggtttaaatttaacgttaagtcgtttaccccgtaggtaaaccggttttccgggtttaccggggggaaccccggggttaaataaacgggtcggttaacggaagttaaacgttaaacccgaaaaggttccgttgggtccgcgttaacgaaccgtaacccg

SEQ ID NO: 435792 - DNA, 567 bp, Homo sapiens
  misc_feature: GZ8MTXP01EHOXX.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagctgggtgcgacaggcccctggacgaagggcttgagtggagtggatggatcagcactttaacaataggaaacacaaagtatcgacacaataatttccgaaagggcaaggatacatcatacgacacagacacatccacgagacactcgacctacagtacgaaactgaacggggaacctaggacgatcgacgacgacacggtccttaatatttagtgtggacgaggaacaactaaactttcccttaccgttacaattaattaccgaagtagtgggttaacgttggttctttttaag

SEQ ID NO: 435793 - DNA, 555 bp, Homo sapiens
  misc_feature: GZ8MTXP01B4CZJ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttgagtggagtgggatggatcagcacttacaagtaggaaaacacgaaagtatacgacactataactttccgaaagggacaagagtacatcatacgaccacagacacactaccacgagacactcgacctacatagaactgaacgggactgagactctacgacgacacggtccttatattagtgtgcgagagttactaaacttccttacttacgattaacgtacgaacgtagtaggttagttgttcttttaacg

SEQ ID NO: 435794 - DNA, 577 bp, Homo sapiens
  misc_feature: GZ8MTXP01C1TMS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagcagttatggtgtcagcgtgggtgcgacaggcccctggacaagggcttgagtggagtgggatggatcgagcactttacaatggaaacacaaagtatcgacacataaacttccgaaagggcaagagtcatcatcgacacagacacataccagacgacactcgacctacagtaggaactggaacggggaaacctgaacgatcgtagaaccgacgaccggtccttaatacttaatggtaagacgagtaacgaactaaacttcccttaccgttaacacgttaagttaacgaacgtagtagggttaagttcgttcgtttttaag

SEQ ID NO: 435795 - DNA, 583 bp, Homo sapiens
  misc_feature: GZ8MTXP01EBBTA.38.25.C03.1.454.CMB.2.raw
  modified_base (348)..(348): a, c, t, g, unknown or other
  modified_base (436)..(436): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacacggcccctggacaagggcttgagtggatgggatggatcagcactttaacaataggaaacanaaagtatgacaacaattaattccgaaagggcaagacgtcaattcaatacgaccaacagacaacatccaacgagacaactgaccctaanactaggaaacctggaacggggtaaacctggaacgtatacgtacgaacggacaaccggtccttaagtattattgaagtacgagacttaaactaactttccttacttaacattaattaccgaatgtaggaacttgttaacgtttttaac

SEQ ID NO: 435796 - DNA, 608 bp, Homo sapiens
  misc_feature: GZ8MTXP01EKEFT.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcgagcactttaacaagtggaaaacacaaaagtatacgacaactataaatttcccgaaaggggtcaaggagttacaatcaatacgaaccaacagaacacaatcccaacgagtacactgacctaacacgtaggaaaccgtagaacgggggtaaacctgaagtactacgtacgacgtaacgaccggtaccttaattaattagttggtaagacggaggaacgaaacgtaaacttcccttaccgttacttataattaccgaacgtagtaggttaagtttcgttaacgtttaag

SEQ ID NO: 435797 - DNA, 502 bp, Homo sapiens
  misc_feature: GZ8MTXP01BHFN8.38.25.C03.1.454.CMB.2.raw
  modified_base (447)..(447): a, c, t, g, unknown or other
  modified_base (477)..(477): a, c, t, g, unknown or other
  modified_base (492)..(492): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttacacaggtccaaacaataagaattactcgctggtaccagcaagaaaccaggacagcctcctaagttgctcatttactgggcatctacccgggagtccgggtcctgaccgattcagcgcagcgggtctgagacagatttcactctcaccatcagcagctgcaggctgaagatgtggctagtttatactgtcagctagtattatagtagtcctnaagtacgtttgggccgggacaagcttgganataacaacgaactgngactgctaac

SEQ ID NO: 435798 - DNA, 549 bp, Homo sapiens
  misc_feature: GZ8MTXP01BLXMD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaagtggaaacacaaagtatacgacacaataatttccgaaagggcaaggagtcaatcaatgaccacagacacatccacgagacactgacctacataggaactggaacggggaacctaggagatccgtagacgacacggccttaatattattgtggcgagagttaacaaacttccttactttacattaattacgaagtagtggttaagtgttcttttaacg

SEQ ID NO: 435799 - DNA, 579 bp, Homo sapiens
  misc_feature: GZ8MTXP01CHSPR.38.25.C03.1.454.CMB.2.raw
  modified_base (430)..(430): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacacggcccctggacgagggcttgagtggagtgggatggatcagcacttacaagtaggaaacacaaagtatcgacacaataactttccgaaagggtcaagagtacatcatcgaccacagacacactccaacgagacactgaccctanagtaggaactaggaacggggaacctggacgtactctaggaccgacgaacggtccttaagtattagttgtgtacgagaacgttaactaaactttcccttaccgttacacttaataccggtaacgtagtaggaacgttgttcgtttttaag

SEQ ID NO: 435800 - DNA, 678 bp, Homo sapiens
  misc_feature: GZ8MTXP01DYWR6.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggcccctaggacgaagggcttggagtggagtgggatggatcagctaacgtttaacaagtaggaaaacaacaaaaggtatacgacaactaattaaacgtttcccgaaaggggacaagggaacttacaaacttacatacgaaaccaaacaacgtaacaacactaccaacgaacgactaaccgtcgtaaccctaacgaagttacgggaaacgtaggaaacgggggtaaacccgttggaaggtaacttacgaacggaccgaaccgtaaccggtacctttaaagtaatttacgttggtaagtacggaaaggtaaacgttaaacctaaatttccccttaccttaattaacttaagttaacgaacgtagtagggttaattcgttaactttttaacg

SEQ ID NO: 435801 - DNA, 572 bp, Homo sapiens
  misc_feature: GZ8MTXP01ADUK5.38.25.C03.1.454.CMB.2.raw
  modified_base (443)..(443): a, c, t, g, unknown or other
  modified_base (538)..(538): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagttgtttacacaggtaccaaacaataagtaattacttcgctggtaccagacaagaaaccaggacagcctacctaagttgctactatttacgtgggcagtccgtacccgggggaggttcccgggggtccctggacccgtagttccgaggccggcaggtcgggtctgagacagtactttcactctacaccatcagcagcctagccgagctagaaagngtcgtaggaccttagtttactactcgtacagtcgtattattagtagttacgtctcgtaagttacgttggggacccgggacaaggtcgttaggganacgtaacgaacgtcgttaggcggctcgctaaccg

SEQ ID NO: 435802 - DNA, 692 bp, Homo sapiens
  misc_feature: GZ8MTXP01EIHM9.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagcgtgggtgcgacgacggcccctaggacgaagggcttggagtggagtgggatggatcgagtcactttaacaagtaggaaaacacgaaaagtatacgacaactaattaaactttcccgaaaggggacaaggagtacaatcaatacgaaccaacaagaacaacactacccgaacgacgactactcgaccctaacacgtacggaaacttaggaaacgggggtaacctaggaacgtaacttaccgtacggaaaccgtaaccgtaaccggttacctttaaattaacgtttagttcggtaacggtacggaaaggtaaacgttaaaccgttaaaactttccccttaaccgtttaacttaacgtttaaacgttaaccggtaacggtaagttacgggttaaagtttaacggtttaacttttttaacg

SEQ ID NO: 435803 - DNA, 672 bp, Homo sapiens
  misc_feature: GZ8MTXP01DE04W.38.25.C03.1.454.CMB.2.raw
  modified_base (450)..(450): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacaagggcttggagtggagtgggatggatcgagcaacttaacaagtaggaaacaacgaaaagtatacgacaactaataaactttccgaaagggcaagtagtcaatcaatacgaccaacagaaccacaactaccaacgagaccactcgaccctanagtaggaaacctaggaacgggggaaccctaggaacgtacgtacctacggaaccgtaaccgtaaccggtaccttttaaagttaacgtttagtttggttaagaaccggttaagtaaacgttaaaccgttaaaacctttcccttaacccgtttaacttaactttaaacgtttaaaccggaaccggttaagttacgggttaaaagttcggtttaacctttttaacg

SEQ ID NO: 435804 - DNA, 633 bp, Homo sapiens
  misc_feature: GZ8MTXP01CGW6I.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacaagggcttgagtggatgggatggatcagcacttacaagtaggaaacacaaaggtatcgacaactaattaaacgtttcccgaaaggggtaccaaggtagttaccaattcaatacgaaccaacaagaaccaacactacccaacgagaccaacgtcgaccctaacgagttacggaaactggaaacggggaaccgtggaagactcgtagaaccgaccgtaaccggtaccttaattatttaagttggtaagtacggaaagtacgaaacttaaactttcccttaaccgtttacaactttaacttaacgaacgtagttagggaacttgttaacctttttaag

SEQ ID NO: 435805 - DNA, 700 bp, Homo sapiens
  misc_feature: GZ8MTXP01A17KY.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctggacgaagggcttggagtggagtgggatggatcgagctaactttaacaaagtaggaaaacaacgaaaagtatacgacaacgtaattaaacgtttcccgaaagggtacaaggacgtacaatacaagtacgaaaccaacacgaccaacactaccgaacgacgaccactcgacctaacgacgtacggaaactaggaacggggtaaacctaggaacgtacgttacgaacggaaccgaaccgtaaccgggtacctttaaagttaactttacgttggtaacggaaccggaaaggtaaacggttaaaccgttaaaaccgtttccccttaaaccgtttaaacttaaacgtttaaacgtttaaccggaacggttaaagttacggggttaaagtttcgttaacgtttttaacg

SEQ ID NO: 435806 - DNA, 670 bp, Homo sapiens
  misc_feature: GZ8MTXP01A2OCP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagctgggtgcgacaggcccctggacaagggcttgagtggatgggatggatcagcattacaatggaaacacaaagtatgacacataacttccgaaagggcaagagtcatcatgaccacagacacactaccaacgagaccactcgacccttaacgatacgggtaaacctagggaacggggtaaaacccgtggaaacgtacttaccgtacggaaaccgggacctaaccggggtacccttttaaggtaaatttacgtttgggttaacggaccgggttaaaggtaaacggttaaaccgttaaaaccgttttcccgtttaaccccgtttaaacgttaatttaacgtttaacccggaacggttaaagtacggggttaaaaggtttcggtttaacttttttaaccgg

SEQ ID NO: 435807 - DNA, 510 bp, Homo sapiens
  misc_feature: GZ8MTXP01EK2EU.38.25.C03.1.454.CMB.2.raw
  modified_base (481)..(481): a, c, t, g, unknown or other
  modified_base (493)..(493): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaaagtatgcacataaatttccaaagggcaagagtcatcatgacacagacacatccacgagcactgcctaacatggaaactgaaggggaacctgagatctgacgacacggccttatattatgtgcgagagacaaattccncttacataatanaacatggaatgctttaa

SEQ ID NO: 435808 - DNA, 666 bp, Homo sapiens
  misc_feature: GZ8MTXP01DXYAO.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttacacttttagctagttatggtgtcagcgtgggtgcgacacggcccctaggacgaagggtcttggaggtggagtgggagtggatcagcactttaacaagtaggaaaacacaaaaggtatacgacaaactattaaacttttccgaaaggggaccaaggtacgtacaattacaagtacgaacccaacacgaacaacactaccgaacgacgaccactcgaccctaacagtacgggaaaccttggaaacggggtaaacccctggaaagtacgttacgtaacggaaccgaccgtaacggtaccctttaattatttaagttggtaagacgaagaacgttaaacgttaaactttcccttaccgtttaacttaattaacgttaacggtaacgtaagtacgggttaagttcgttaaccttttttaag

SEQ ID NO: 435809 - DNA, 690 bp, Homo sapiens
  misc_feature: GZ8MTXP01B6S8M.38.25.C03.1.454.CMB.2.raw
  modified_base (353)..(353): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacacggcccctggacaagggcttgagtggagtggatggatcagcacttacaagtagaaacacaaagtancgacacagtaactttccgaagggcaagagtacatacatacgaccaacagacaacgactacccgaacgagaccaactcgacctaacacgttacggaaacgttacgaacggggaaacccttaggaacgtacttaccgacggaaccgaaccgtaaccgggttaccctttaaagtttaacgtttaacgtttggtaaccggtaaggttaaacgggtaaaacttaaccggttaaaaaaccgttttcccgttaacccgttttaacgttaaaactttaacgttttaacccggaaacgttaacggtttaaggggttaaacgttcggttttaacttttttaaaccgg

SEQ ID NO: 435810 - DNA, 624 bp, Homo sapiens
  misc_feature: GZ8MTXP01ET3D8.38.25.C03.1.454.CMB.2.raw
  modified_base (218)..(218): a, c, t, g, unknown or other
  modified_base (330)..(330): a, c, t, g, unknown or other
  modified_base (343)..(343): a, c, t, g, unknown or other
  modified_base (362)..(362): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggccncagtgaacgtctctgcaaggtcttctggttactacttttagctagttatggtgtcagcgtgggtgcgacgacggcccctaggacgaagggtcttggagtggagtgggatggntcgagcacttaanaagtaggaaacacaaagtntacgactaactattaacgtttacccgaaagggcaaggtacgtacatacatacgaaccaacaacgacaacactaccaacgacgacactcgacctacgagtacggaacgtacggaacgggactaggaagacgtacgtacgaccgaacgtaccggtacctttaattaacgttagttgtgacgttaaggaacgttaacgtaaacttcccttaacgtttaccatttaacgtacgtaacgtagtaggttaattcgttaacgttttaag

SEQ ID NO: 435811 - DNA, 539 bp, Homo sapiens
  misc_feature: GZ8MTXP01A0KUB.38.25.C03.1.454.CMB.2.raw
  modified_base (396)..(396): a, c, t, g, unknown or other
  modified_base (421)..(421): a, c, t, g, unknown or other
  modified_base (449)..(449): a, c, t, g, unknown or other
  modified_base (472)..(472): a, c, t, g, unknown or other
  modified_base (500)..(500): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacaggcccctggacaagggcttgagtggagtgggatggatcagcacttacaagtggaaacacgaaagtatcgacacataactttccgaaagggcaagagtcatcatgaccanagacacatccagagcactgacctanataggaactgacggggaactgagatcgngacgacacggtcttatattatgngcgagacgactaaacttccttacgttanacttaagttaccgaagtataggaagttcgttcttttaag

SEQ ID NO: 435812 - DNA, 590 bp, Homo sapiens
  misc_feature: GZ8MTXP01CAWQJ.38.25.C03.1.454.CMB.2.raw
  modified_base (317)..(317): a, c, t, g, unknown or other
  modified_base (543)..(543): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattactcgctggtaccagcaagaaaccaggacagcctacctaaagttcgctctatttacgngggctagtccgtacccgggaggtcccgggtcctgaccgtacttcgagcggcaggcgggtctgagacagtacttcactctcacatcagcacgctgcgaggctagaagtagtgtcggtacgttaagttttattacgtgttaccaagtccgtaaggttaattaagtagttaacgtccttgaacggtttacgtttcggggacccgggggaacctaaaggtcgttaggganaacgttaacgaaaacggtaacgttgggtacggcgtcgaactaacccg

SEQ ID NO: 435813 - DNA, 669 bp, Homo sapiens
  misc_feature: GZ8MTXP01D8F0U.38.25.C03.1.454.CMB.2.raw
tcagtcgatcacgtcacgaccggtgctcgatttagtagtgtagatttgggttttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggtcttctggttactacttttagctagttatggtgtcgagcgtgggtgcgacgacggccctggacgaagggcttggaggtggagtgggagtggatcagctacttaacaagtaggaaacaacaaagtagtacgacaactaataaactttcccgaaagggacaagagtacaatcaagtacgaaccaacacgaacacaactaccgaacgacgaccaactacgacctaacaacgttacggaaacgtacggaaacggggtaaccgtaaggaacgtaacgtacgtaacgaaccggtaacgtaaccggtacctttaaagttactttaacgttggtaacgacgttaagaaacgttaaacgttaaacttccttaaccgttaacttaacgttaagttaaccgaacgttaaggtaggttaaggttcttaacgtttttaacg

SEQ ID NO: 435814 - DNA, 665 bp, Homo sapiens
  misc_feature: GZ8MTXP01DVGF5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttcgtggttactactttttagctagttattgtgtcagcgtgggtgcgacacggcccctaggacaagggcttgaggtggagtgggatggatcagctaacttaacaagtaggaaaacaacaaagtatacgacaactaattaaacgtttccgaaaggggtacaaggagttacaattacaacgtacggaaaccaacgaaacgaaccaaaccactacccgaacggaacgacctaacttacggacccctaaagaacgttacgggaaacgttacgggaaacggggtaaacccgttggaaactacgtacgtacgaaccgacgtaacgtctttaagtattagtgtaacgacgaggtaaacaacttaaacttccttaacgttacttaacttaagttaccgaagtaagtaggttaaagttcgttaaccttttaag

SEQ ID NO: 435815 - DNA, 667 bp, Homo sapiens
  misc_feature: GZ8MTXP01E25SE.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggcccctggacgaagggtcttgagtggagtggatggatcgagcacttaacaagtaggaaacaacaaaagtatacgacaacgtaattaaatttcccgaaaggggtacaagagtacaattcaatcgaaccaacaagaccaacactaccgaacgagccaacgttcgaccctaacagtaacgggaactaggaacggggtaacctagacgtacgtacgtacgaccgtaacgaccggtacctttaagttaattagttggtaacggacgaaagggtaaacgttaaaccgttaaactttacccttaacccgtttaaacaacgtttaaacgttaaccggtaaacgtaacggttagggttaaacgtttcggtttaaccttttttaacg

SEQ ID NO: 435816 - DNA, 663 bp, Homo sapiens
  misc_feature: GZ8MTXP01EAJDI.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatgggtgtcagtcgtgggtgcgacgcggcccctggacgaagggcttgagtggagtgggatggatcgagctaactttaacaaagttaggaaaacacgaaaagtatacgactaactaattaaactttcccgaaagggacaaggagtcatcaagtcgaacacaagaccacactaccaacgacgacacgtacgaccctaaacgacgtacggaaacgtacggaacggggtaaacgtagaaagtacgtacgtaacgaaccgtaacgtaaccgttactttaagttagtttagtcgtaacggtaacgttaaaggtaaacgttaaacgttaaacctttacccttaacgttaacttaacgtttaacgtaacgtaacgttagtaggttaagttcgtttaacgtttaacg

SEQ ID NO: 435817 - DNA, 587 bp, Homo sapiens
  misc_feature: GZ8MTXP01AZEFT.38.25.C03.1.454.CMB.2.raw
  modified_base (317)..(317): a, c, t, g, unknown or other
  modified_base (419)..(419): a, c, t, g, unknown or other
  modified_base (462)..(462): a, c, t, g, unknown or other
  modified_base (466)..(466): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccagagtgtttacacaggtaccaaacaataagtaattactcgctggtaccagcaagaaaccaggacagcctactaagtgctctattacgngggacacgtccgtacccggggacgttcccggggtcctcggaccgtacttccgaggccggcacggcgggtctggagacagtacttcactctacacatcagcancctagcaggctagaagatgtggacttaagtttataactcgtanagtntaagttattagtaggttactccgtgtaaggttacggtttcggggacccgggggttaacaacggtcggttaggaacgacgtaacgaaacgtaaccgttaggtacggacttcgaaccgtaacc

SEQ ID NO: 435818 - DNA, 580 bp, Homo sapiens
  misc_feature: GZ8MTXP01C03NC.38.25.C03.1.454.CMB.2.raw
  modified_base (265)..(265): a, c, t, g, unknown or other
  modified_base (316)..(316): a, c, t, g, unknown or other
  modified_base (405)..(405): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattactcgntggtacagcaagaaaccaggacagcctacctaaagttcgctctatttacgngggcatccgtacccggggagttccggggtccctgaccgtattcagtcggcaggccgggtactgagtacagtacttcactctcacatcancacgcctagcgagctagaagagtgtggacttaaggtttaattactcggtacagctagttaattagtagtacgtccctgtaacgtaacgttttcggggacccggggttacgtaaaggtcgttaggagttaacgtaacgaaaaccgtaacgttggtcggttacgtcggccgtaaccg

SEQ ID NO: 435819 - DNA, 549 bp, Homo sapiens
  misc_feature: GZ8MTXP01DUZBU.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacagggctgagtggatgggatggatcagcactttacaatggaaacacgaaagtatcgacactaattaactttccgaaagggacaagagtcaatcatcgacacagacacactaccacgagacactcgacctacatggaactggacggggaactgagatcgtagacgacgaccggtcttaatatttacttgaagtcgagaagttactaaattcccttacttacataactacgaacgtagtggatcgttcttttaac

SEQ ID NO: 435820 - DNA, 739 bp, Homo sapiens
  misc_feature: GZ8MTXP01BLMCL.38.25.C03.1.454.CMB.2.raw
  modified_base (453)..(453): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttcgtggttactacttttagctagttatggtgtcagcgtgggtgcgacgacggccccgtaggaccgaagggtcttggagtggagtggggatggatcgagactaactttaacgaagtacggaaaacaacgaaagtactacggaccaaataattaaacgtttacccgaaaggggtaccaaggtacgtacctaacgtactaacgtacggaacccaanaacgaaaccacgtaactacccgaacgaacggacctaactaccgtacccttaacaacgtacgggaaaccgttaggaaaccggggtaaaccgttagaacggtacgttacgacggaaccgaacgtaaccgggtacctttaagttacgtttaacgttgggtaacgtaacgaacggtaaacttaaacgttaaaccgtttacccgttaaccgttaaccttaaacgtttaaacggttaaccgtaaacggttaggttacgggttaaagtttccgttttaacgttttttaaccgg

SEQ ID NO: 435821 - DNA, 591 bp, Homo sapiens
  misc_feature: GZ8MTXP01CGXSP.38.25.C03.1.454.CMB.2.raw
  modified_base (583)..(583): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagcgtgggtgcgacaggcccctggacaagggcttggagtggatgggatggatcagcacttacaataggaaacacgaaagtatcgacactataactttccgaaagggcaagagtcatcatcgaaccacagacaacactaccacgagacactgccctaacagtacggaacttaggaacggggaacccttaggaaggtactacgtacggaaccgacgtaaccgggtccttaaattagttagttggtaagcggttaagaagttaactaaactttccttaccgttaacattaataccgaagtagtacggagttcgttnttttaacg

SEQ ID NO: 435822 - DNA, 604 bp, Homo sapiens
  misc_feature: GZ8MTXP01BK4CA.38.25.C03.1.454.CMB.2.raw
  modified_base (372)..(372): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtgacagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggagtgggatggatcagcacttacaatggaaacacaaagtatcgacacataatttccaagggcngagtcatcatagaccacagacacactaccaacgagaccactcgacccttacacgtaggaaactaggaacggggtaaacctggaacgagtaccgtaggaaccgtacgaacccgggtcctttaagttatttaacgttggtaacgtacggaaagtaacggaaacgtaaaactttcccttacccgttaaccttattaacttacgaaccgtatagggttaatcgttaacgttttaag

SEQ ID NO: 435823 - DNA, 647 bp, Homo sapiens
  misc_feature: GZ8MTXP01AXNQ2.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctaggacaagggcttgagtggagtggatggatcagcacttacaagtaggaaacacgaaagtatacgacaagtaataaatttcccgaaaggggccaaggacgttacgaatacgaatacggaacccaaacgaacgaaccaacaactacccaacgaacgaccaactcgacccttaacgagttacgggaaacttaggaacggggtaaacccttaggaaacgtactacgtacggaaccgtaaccgtaacggtcctttaagtatttacgtggtaagacgagtaaacgttacgtaaacttcccttaacgttacttattaacgttaacgaacgtaagtaggttaagttgttaaccgttttaag

SEQ ID NO: 435824 - DNA, 569 bp, Homo sapiens
  misc_feature: GZ8MTXP01DKLMZ.38.25.C03.1.454.CMB.2.raw
  modified_base (443)..(443): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgctggtaccagcaagaaaccaggacagcctacctaagttgctcatttactgggcatccaccggggagttcccgggtcctgaccgacttcagcggcaggcgggtctgagacagtacttcactctcaccatcagcagccctgcaggctgaaagagtgtggtactagtttaattactgtacngtctagttaatttatagttacgtcctgtaaggttcgttttcggggacccgggggttaacaaacggtccgttagggaggttaacttaacgaaaaccggtaacgttggcggacgttcggcctaacccg

SEQ ID NO: 435825 - DNA, 615 bp, Homo sapiens
  misc_feature: GZ8MTXP01CH16U.38.25.C03.1.454.CMB.2.raw
  modified_base (361)..(361): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggcttctggttacacttttagctagttatggtgtcagctgggtgcgacaggcccctggacgaagggcttggagtggagtgggatgggatcagcactttacaagtaggaaacacaaagtatcgacanattaattgaacgtagggcagagtcatcatagaccacagacacactaccagacgacactcgaccttacgagtacggaaaccgtgggaacgggtaaccttggaacgattccgagaaccgtaaccgtacggtaccctttaagtacttagttcgtggaccgtaagaacgtaaaccttaaactttccccgttaacctttaactaacgttaaacgtttaacccggaagttacgttaggggtaaagttcggtttttaaccg

SEQ ID NO: 435826 - DNA, 548 bp, Homo sapiens
  misc_feature: GZ8MTXP01CWPF8.38.25.C03.1.454.CMB.2.raw
  modified_base (477)..(477): a, c, t, g, unknown or other
  modified_base (496)..(496): a, c, t, g, unknown or other
  modified_base (505)..(505): a, c, t, g, unknown or other
  modified_base (520)..(520): a, c, t, g, unknown or other
  modified_base (529)..(529): a, c, t, g, unknown or other
  modified_base (542)..(542): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacaagggcttgagtggatgggatggatcagacaactttacaaagtaggaaaacaacaaaagtatcgacaactattaaatttcccgaaagggacaagacgtcaatcaatcgaaccacagacacataccaacgacgcaactgacctaacataggaactagaacggggtaacctgaagatcgngacgacacggtcttatatntgtgcaganactaatcttacgttnataatacgngatgttatcgttntttaac

SEQ ID NO: 435827 - DNA, 583 bp, Homo sapiens
  misc_feature: GZ8MTXP01CM1DM.38.25.C03.1.454.CMB.2.raw
  modified_base (313)..(313): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaaacaaataagaattacttcgctggtacagcaagaaaccaggacagcctctaagtgctctatttacnggcatccgtaccgggagtcccggggtcctcgaccgacttcgagcggcaggcgggtctgagacagtactttcactctcaccatcagcagcctgccgaggctagaagtatggtaggtacttagttttaacttacgtggtacagactagttaattagtagttacgtcccttgaaggttacgtttcgggggacccggggaacctaaaggtccgttagggacgttaaacgttaaccgaaaacggtaacgtgggtacggcttcggaaccctaaccg

SEQ ID NO: 435828 - DNA, 623 bp, Homo sapiens
  misc_feature: GZ8MTXP01D8GRW.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaaacaataagtaattacttcgctggtaccagacaagaaaccaggacagccctacctaaagttgctactatttacgtgggacacgttccgtaccccggggagttcccgggggtccctggaccgtacttccgaggcggcgaggcgggtctggacgacagtactttcactctacacatcagcagccctgactaggctagaagagtggtaggacttaaggttttattaaccgtgttaccaggtctaaggttaattataaggttacgtaccctgaacggttacggttttcgggggacccgggggttaacctaagggtccgttagggacgaaacgtaacgtaaaacggtaacgttcgggaggttcctaacggcccgtaacccg

SEQ ID NO: 435829 - DNA, 697 bp, Homo sapiens
  misc_feature: GZ8MTXP01D6UZA.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatgggtgtcagcgtggtgcgacgacggcccctggacgaagggtcttgaggtggagtgggatggatcgagctaactttaacaagtaggaaaacaacgaaaagtatacgcctaaacaattaaactttccgaaagggacaagggagtaccaagttacaaacgttacggaaacccaaacgaacgaaccaacctaactaccccgaacgaaacgaccgtaacctacggtacccgtaacacgttaacgggaaacgtacggaaacgggggtaaaccctaggaaacgtacgtaccgtaacggaacccgaacgtaaccgggtacctttaagtaactttaagttggtaacggtacgaaggtaaacgttaaaccgttaaaattccccttaacttaacttaattaacgtaacgtaacgtagtaggaacgttcgttaacttttaag

SEQ ID NO: 435830 - DNA, 701 bp, Homo sapiens
  misc_feature: GZ8MTXP01C9G67.38.25.C03.1.454.CMB.2.raw
  modified_base (216)..(216): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggctggggctnagtgacgtctcctgcaaggcttctggttacactttttagctagttatggtgtcagcgtgggtgcgacgaggcccctaggacaagggcttgagtgggagtggatggatcgagcaacgtttacaagtaggaaacaacaaaagtactgactacaagttaaactttcccgaaaggggacaaggtagtactaatcaagtacgaccaacacgaacacaacaccaacgagacctacgtcgacctaaccaagttacggaaaccttagggaaacggggaacccgttaggaaacgtacgttacgtaaccggaaccgacgtaaaccgggttacctttaagtttaaagttacgtttaggttaaggtacggaaagggttaaccgttaaacgttaaaaaccttttccccttaaccccgttttaaacttaatttaaacgtttaacggggaaccttaagggttacgggttaaaacgggtttttcgtttaaccgtttttaag

SEQ ID NO: 435831 - DNA, 756 bp, Homo sapiens
  misc_feature: GZ8MTXP01DQHNR.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttattgtgtcagctgggtgcgacacggcccctggacaagggtcttgagtggatgggatgggatcgagctacttaacaagtaggaaacacaaagtatcgacactattaacttccgaagggcaagagtcatcatcgacacagacacactacccgacgacgaccaacttcgacccttaacgaacgttacgggaaacttacgggaaacggggggtaaacccttagggaaacggtacgtttccgtaacgggtaacccggaaaccgtaaaccggggtttacccttttaaagtttaaactttttaacgtttggggttaacggaaccgggttaaaggggtaaaccgttaaaaccgtttaaaaaacccgtttttccccgtttaaacccccgtttttaaacgttaaaaccttttaaaccggtttaaaacccggggtaacggtttaaacgggtttaacgggggttaaaacgtttttcgggtttaacccgttttttttttaaaccgg

SEQ ID NO: 435832 - DNA, 615 bp, Homo sapiens
  misc_feature: GZ8MTXP01ESZ7Y.38.25.C03.1.454.CMB.2.raw
  modified_base (453)..(453): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacgaagggcttggagtggagtgggatggatcagctaactttaacaaagtaggaaaacaacgaaaagtatacgactaactaattaaacgtttcccgaaaggggcaaggagtcaatcatcgaaccacacgacacactccacgagacactcgacctaanagtaggaactaggaacggggtaacctggaagtacgtacgtacgaaccgaacgaccggtacctttaattatttagttggtgacgaggaacttaaactaaactttcccttacgttacattaacgttaacgaacgtagtaggttaagttcgttaacgttttaacg

SEQ ID NO: 435833 - DNA, 819 bp, Homo sapiens
  misc_feature: GZ8MTXP01D0F29.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggccctggacgaagggtcttgagtggagtgggatgggatcagctactttaacaaagtaggaaaacaacgaaaagtatacgacaaactaattaaacgtttcccgaaaggggacctaaggaacgtacctaaacttacaacttacgggaaacccaacgaaacgaaccaacctaaactaccccgaacgaaacggtacctaaccctttacggaccccttaaacgaagttacgggaaaaacccgttacgggaaacgggggaaaccccgtttaaggggaaccgtaaactttaccggtaaccggaaacccggttaaccggtaaacccgggtttacccttttaaaatttaaccgtttttaaaggtttccggggtaaggaaccgggttaaaagggtaaacgttaaaacccgttaaaaccgttttacccccttaaccccggttttaaaacgttaaactttaaaccgtttaaacccgggggtaaacgttaaacggtttaacggggggttaaaacttttcgggtttaacccgttttttttaaacg

SEQ ID NO: 435834 - DNA, 553 bp, Homo sapiens
  misc_feature: GZ8MTXP01DQOGF.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggccccctggacgaagggcttgagtggatgggatggatcagcactttacaatggaaacacaaagtatgcacataattccgaagggcaagagtcatcatcgaccacagacacatccacgagacactgcctacataggaactgaaggggaacctgagatctagaccgacgacggtccttaatattagttggtgcgaagagttaactaaacttccttaccgttacttaattaagtaacgaacgtatagggttaattgttaactttttaac

SEQ ID NO: 435835 - DNA, 732 bp, Homo sapiens
  misc_feature: GZ8MTXP01E1ICY.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggagtgggatggatcagcactttaacaataggaaacaacaaagtatacgacaactaattaaactttcccgaaagggggtaccaaggtaagtcaaattaccaagtacggaaacccaacaacgaacaaccaactacccaacgaacgaccaaccttcgacccctaacaacgttacgggaaaaccttacgggaaacgggggtaaacccgtaggaaacgtaacttaccgtaacggaaacccgaaccgtaaacccgggtaccctttaaagtttaacttttaagtttacgggttaaggtaccggaaacggtaaacgttaaaccgttaaaacctttaccccttaacccgtttaaacttaactttaaacgtttaaccgtaaacgggtaacgttacgggttaaacggttaacggtttaacccgttttttaacg

SEQ ID NO: 435836 - DNA, 630 bp, Homo sapiens
  misc_feature: GZ8MTXP01BBFHY.38.25.C03.1.454.CMB.2.raw
  modified_base (409)..(409): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactccccaggttcaattggtgcagtctggagctgcggtgaagaggcctggggcctcagtgaacgtctcctgcaaggcttctggttacacttttagctagttatggtgtcagcgtgggtgcgacgacggccccgtggacaagggcttgaggtggatgggatggatcagcactttacaagtggaaacacaaagtatacgacacaataactttccgaagggacaagagtacatcatcgacacagacanactccaacgacgacactcgacctaacagtacggaaacttggaacggggtaaacccttaggaacgtacgttacctaggaaccggaacgtaaccgggtacctttaattaacgtttagttcgtaaggtaccgaaagggtaacaaacgttaaacttcccttaaccgttacttaacgtttaactaacggaaccgtaggtacggttaagttcgttaacctttttaag

SEQ ID NO: 435837 - DNA, 748 bp, Homo sapiens
  misc_feature: GZ8MTXP01DDW0H.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttctggttacactttttagctagttatggtgtcagctgggtgcgacaggcccctggacaagggcttgagtggagtgggatggatcagcactttacaataggaaaacacaaagtatcgacaactaattaaactttcccgaaaggggtacaaggagttaccaattacaatacggaacccaacaacgaaccaacaactacccgaacggaacgaccaaaccgttacggacccttaacgaacgttaacggggaaaaccgttacgggaaacggggggtaaaaccccgtttagggaaaaccggtaacgttaccgttaacgggaaacccggtaaaccgtaaacccggggttacccgttttaaattaaacgttttaacgtttagggtaacgggtaccggaaaggtaaacggaaaccgttaaaacttttccccttaacccgtttaacttaaactttaaacgtttaaaccggtaaccggttaagttagggttaaacggtttggttaacgtttttttaacg

SEQ ID NO: 435838 - DNA, 632 bp, Homo sapiens
  misc_feature: GZ8MTXP01DGSJ4.38.25.C03.1.454.CMB.2.raw
  modified_base (351)..(351): a, c, t, g, unknown or other
  modified_base (360)..(360): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcagtgaacgtctcctgcaaggcttctggttactactttttagctagttatggtgtcagcgtgggtgcgacacggccctggacgaaggcttgagtggagtggatggatcagctaacttaacaagtaggaaaanacaaaagtntacgacactaattaaactttccgaaaggggtcaaggtaacgtaccaaattcgaatacggaaaccaacgaaacgaacaacaactaccaacgacgactacgtcgacctaacagtacggaaactggaacggggaaccttggaacgtattaccgaagaccgaacgtacggtaccttaaattacgttaattggtaagacgaaggtaacttaaacgttaaacttcccttacttacttaattaacgtaacgaagtagtagggttaatgttccttttaag

SEQ ID NO: 435839 - DNA, 606 bp, Homo sapiens
  misc_feature: GZ8MTXP01CI09H.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacgaagggcttgagtggatgggatggatcagctacttaacaagtaggaaaacacgaaagtatacgacactaattaatttcccgaaagggcaagagtcatcatcgaaccacagacacactccacgacgacactcgacctaacgatacggaactaggaacggggaactaggacgtactcgtacgacgacgtacggtaccttaattatttagttggtaacgacgttaagtaacgttaaacgttaaacctttcccttaaccttacttacttaacgtacgaacgtaagtaggttaagttcgttaacgtttttaacg

SEQ ID NO: 435840 - DNA, 584 bp, Homo sapiens
  misc_feature: GZ8MTXP01DNLTX.38.25.C03.1.454.CMB.2.raw
  modified_base (429)..(429): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcactttacaagtggaaacacgaaagtatcgacacaataaatttcccgaaagggcaaggagtcaagtcaatcgaacacagacacactaccagagacactcgcctanatggaaactggaacggggtaacctgaacgtatactgacgacgaacggtccttaatactttattggtaacgtcgaagtacgaactaaacttcccttaaccgttaacaacttaagttaacggaacgtagtagggttaaagttcgttccgtttttaag

SEQ ID NO: 435841 - DNA, 737 bp, Homo sapiens
  misc_feature: GZ8MTXP01BE1A0.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctagggaacgaagggtcttggaggtgggagtgggatgggatcgagtacgaactttaacgaagtaggaaaacaacgaaaagtactacgacaacaattaactttacccgaaagggcaaggagtaccaattaccaatacgaaccaacgacgaacaacacgacccaagaacgaccaacgttacgaccccttaaagaacgtacgggaaaacttacgggaaacggggtaaacccgttaggaaacgtaacgtttaccgtaacggaacccgaaacgtaacccgggttaccctttaaagttacgtttaaacgtttggtaacggtaaggttaaacgaaacgttaaaccgttaaacgtttaccccttaaccgtttaaacttaactttaaaccgttaaacgggtaacgttaacggttaagggttaaacgttcggttttaacgttttttaaaccg

SEQ ID NO: 435842 - DNA, 662 bp, Homo sapiens
  misc_feature: GZ8MTXP01DK1OK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacacggcccctggacgaagggcttggaggtggagtgggatgggatcgagacactttaacaagtaggaaaacaacaaagtatacgacaactaattaaactttaccgaaagggtaacaaggtaacgtaccaattaccaagtacgaaacccaacaacgaacaacactacccaacgacgacactcgacctacagtacggaaactggaacgggtaacctggaacgtactacgtacggaaccgacgtaaccggtacctttaattaagtttacgttggttaacgacggttaagtaaacggttaaacttaaaacctttcccttaacctttacttaacttaacgttaacgaacgtagtagggttaagttgttaacgtttttaacg

SEQ ID NO: 435843 - DNA, 665 bp, Homo sapiens
  misc_feature: GZ8MTXP01EJFE6.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagcgtgggtgcgacacggccctggacaagggcttgagtggagtggatggatcagctacttaacgaataggaaaacaacaaaagtatacgacaactaattaaactttcccgaaaggggtccaaggagtacatacatacgaccaacagaacacactaccgaacgagaccactcgacctaacagtaggaaacctggaacggggaaaccgtgaacgtacgtacgtacggaaccgtaacgtaccggtacctttaaattattaacgttgggtaacgacgggaaagtaaacggttaaactaaaacctttccccttaacctttaaacggttaactttaaacgttaacccgtaaacggtaagttaggggttaagtttaacggttaacgtttttttaaaccg

SEQ ID NO: 435844 - DNA, 681 bp, Homo sapiens
  misc_feature: GZ8MTXP01DAP66.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggtcttctggttacactttttagctagttatggtgtcagcgtgggtgcgacgacggcccctaggacgaagggcttgagtggagtgggatggatcgagctaactttaacaagtaggaaaacaacgaaaagtatacgacaactaattaaactttaccgaaagggtacaaggaagtacaaattcaatacgaaccaacgaacacaacaactaccaacgacgacacttcgaccctaagagtaggaaactaggaacggggtaacctaggaaagtactacgtacggaaccgtaacgtaaccgggtcctttaaattacgtttaagttggtaagaaccggttaaaggtaaacgttaaacgttaaaactttcccttaaccgtttaaaccttaatttaaacgttaaccggaacgtaaggttacgggttaaagtttcggttaacttttttaaccg

SEQ ID NO: 435845 - DNA, 602 bp, Homo sapiens
  misc_feature: GZ8MTXP01CN2NA.38.25.C03.1.454.CMB.2.raw
  modified_base (303)..(303): a, c, t, g, unknown or other
  modified_base (317)..(317): a, c, t, g, unknown or other
  modified_base (421)..(421): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgacaagtccagccagagttgtttacacaggtaccaaacaataagaattactcgactggtaccagacaagaacgagacagcctactagtnctactagtttacgnggactacgtccggaccgggtacggtcccggtccctagaccgtactcgaggcggacgacggtcgggtctggacgacgtaagtactttacacctactaccacctanaccgaagcacgtccgagacgacggtataaggaagtgtggtaggtaacttagttttaactaccttggacagtataagttaatagtacgtacgtactgtaacgttcggttcgggggaccggttacgaaacggtgaggttagacttaaaccgaaaagtcgtaggtcgggactcgaacgtaaccg

SEQ ID NO: 435846 - DNA, 643 bp, Homo sapiens
  misc_feature: GZ8MTXP01DZ07G.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacgaagggcttgagtggagtgggatggatcgagcactttaacaagtaggaaaacaacgaaagtatacgacaactaattaaactttcccgaaaggggtaccaaggtagtaccaattacaagtacggaaccaaacgaacgaacaacaactacccaacgaagaccacgtacgacctaacgagtaggaaactcggaaacgggggtaaccctaggaagtaacttacgacggaacgaaccgtacggtacctttaattaatttagttggtaagacggaagtaacgaaactaaactttcccttacctttacaatttaacgtaaccgaagtagtagggttaagttcgttcgtttttaag

SEQ ID NO: 435847 - DNA, 582 bp, Homo sapiens
  misc_feature: GZ8MTXP01CIUJY.38.25.C03.1.454.CMB.2.raw
  modified_base (467)..(467): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgtttacacaggtaccaaacaataagaattacttcgctggtaccagacaagaaaccaggacagccctacctaagttgctctatttactgggctacttccgtacccggggagttcccggggtccctgaccgtacttcagcggcaggcgggtctgagacagtattcactctacaccatcagcacgcctgcgaggctaggaagagtgtggacttaaggttttaatttaccgtagttcagtntaaggttaattatagtagttccctgtaacgttacgttttcggggcccgggggaacgtaaacggtcgttaggagttactaacgaaaacgtaacgtaggtcgggactcgcgtaaccg

SEQ ID NO: 435848 - DNA, 552 bp, Homo sapiens
  misc_feature: GZ8MTXP01DE5YW.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacgtttacaatggaaacacgaaagtatacgacatataacttccaagggtcaagagtcatcatcgacacagacacactccacgagacactcgcctacatggaactggacggggaacctgaagtactctagacgactacggtctttatagttatggtcgcgaggtaacacgttaaacttccttaccgttacattaattaacgcgtataggttagttcgttcttttaag

SEQ ID NO: 435849 - DNA, 635 bp, Homo sapiens
  misc_feature: GZ8MTXP01CLTZ5.38.25.C03.1.454.CMB.2.raw
tcagtcgatcacgtcacgaccggtgctcgatttagtagtgtagatttgggtttggggaaccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacgaagggcttggagtggagtgggatgggatcgagctaactttaacaagtaggaaaacacaaagtatcgacaactaattaaatttcccgaaaggggacaaggagtacatcatacgaaccacacgacacactaccaacgacgcactcgacctacgagtacggaactaggaacggggtaacccgtaggaacgtactacgtacgaaccgaacgtaccggtacctttaattatttagttgtaacgcgaagtaacgaacttaaaacgtttcccttaaccgtttacttaactttaacgttaacggtaacgtagttacgggttaagttcgttaacgtttttaacg

SEQ ID NO: 435850 - DNA, 599 bp, Homo sapiens
  misc_feature: GZ8MTXP01BGOUA.38.25.C03.1.454.CMB.2.raw
  modified_base (316)..(316): a, c, t, g, unknown or other
  modified_base (439)..(439): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagtagtgtttacacaggtaccaaacaataagattactcgactaggacagcaacgaaacgaggacagcctactaagtgctctaatttacgngggctagtaccgtacccgggggagttcccggggtcctggaaccgtacttccgaggccggtcacggcgggttctggacgactagtacttcactctacacatcagcacgctacgcagctagaagngtagtacgagttagtttattaccgtgtacagtactagttattaatagtacgtcctgtaacgtcggtttacggggaccggggaacgtaacggtcggttacggttaggaaccgttaacgaaaacgtaacgtacggtacgggttactaacggaacctaacccg

SEQ ID NO: 435851 - DNA, 681 bp, Homo sapiens
  misc_feature: GZ8MTXP01AWOEQ.38.25.C03.1.454.CMB.2.raw
tcagtcgatcacgtcacgaccggtgctcgatttagtagtgtagatttgggtttggggacccaaaaacccacacccctccttgggagaatcccctagatcacagctcctcaccatgggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttggagtggatgggatggatcgagtcactttaacaattaggaaaacacaaagtatcgacactaataaactttcccgaaaggggaccaagggtaagttacccgaattaccgaagttacggaacccaacaacgaacccaacaacgtaccccaaacgaacggacctaacgttacggaccccttaaacgaacgttacgggaaaccttacgggaaacgggggtaaacccgttaggaaacggtaacttaccgtacggaaccgaacgtaaccgggtaccctttaagttacttacgttggtaagacgagtaacgaaccgtaaacttcccttaccttaccttattaacgttacgaacgtagtaggttaacgttgttccgttttaa

SEQ ID NO: 435852 - DNA, 591 bp, Homo sapiens
  misc_feature: GZ8MTXP01D90LE.38.25.C03.1.454.CMB.2.raw
  modified_base (408)..(408): a, c, t, g, unknown or other
  modified_base (434)..(434): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagctgggtgcgacacggcccctggacaagggcttgaggtggagtgggatggatcagcacttaacaagtaggaaacacaaagtatacgacactaataatttacccgaaagggtacaagagtcatcatcgaccacanacacatccagacgacactcgacctanagtagaactagacggggaactgaacgatctagacgaactacggtacctttaattattaagttgtaagtacgaagtaacgaacgtaaactttcccttaccgttaacttaacttaacgttacgaaccgtagtagggttaaagttcgttaactttttaag

SEQ ID NO: 435853 - DNA, 565 bp, Homo sapiens
  misc_feature: GZ8MTXP01DIW08.38.25.C03.1.454.CMB.2.raw
  modified_base (391)..(391): a, c, t, g, unknown or other
  modified_base (418)..(418): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcactttacaagtaggaaacacaaagtatgacacataattccaaagggcaagagtcatcatcgaccanagacacatccagagacactcgacctanagtaggaactggaacggggaacctgaacgactacgtcgacgacgaacggtccttaatattaagttggtgacggagaacgaactaaaacttccttaccttacaattaacgttaacgaacgtagtaggttaagtcgttaacttttaacg

SEQ ID NO: 435854 - DNA, 561 bp, Homo sapiens
  misc_feature: GZ8MTXP01DYKWY.38.25.C03.1.454.CMB.2.raw
  modified_base (433)..(433): a, c, t, g, unknown or other
  modified_base (491)..(491): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagctgggtgcgacaggcccctggacaagggcttgagtggatgggatggatcagcactttacaatggaaacacgaaagtatcgacagattaactttcccgaaaggggcaagagtcaagtcatcgaaccacagacacatccacgagaccactcgaccctanataggaaactggaacggggaacctggaagatcagacgacgacgtccttatattattgngcgagagttacaaactttccttacttcaattaacgttacgaacgtatagggaagttcgttctttttaacg

SEQ ID NO: 435855 - DNA, 615 bp, Homo sapiens
  misc_feature: GZ8MTXP01BZFUM.38.25.C03.1.454.CMB.2.raw
  modified_base (354)..(354): a, c, t, g, unknown or other
  modified_base (413)..(413): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcacttacaatggaaacacaaagtatgcanataattccaagggcaagagtcatcatgaccacagacacatccacgagacactgccctanagtcggaaactggaacgggggaaacccttggaacgattaccgtggaaccgaacctaaccgggtaccctttaagttactttaacgttggtaacggaccggttaaaggtaacgttaaaccgtaaaactttcccttaaccctttaacgttaacttaattaacccggaacgtaagttaggggaacgttcggttaacttttttaacg

SEQ ID NO: 435856 - DNA, 648 bp, Homo sapiens
  misc_feature: GZ8MTXP01CPP59.38.25.C03.1.454.CMB.2.raw
  modified_base (249)..(249): a, c, t, g, unknown or other
  modified_base (313)..(313): a, c, t, g, unknown or other
  modified_base (335)..(335): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagacctcctggctgtgtctcgtggcgagacgggccacatcaactgcaagtccagccagagtgtttacacaggtaccaaanaataagaattactcgctggaccagcaagaaaccaggacagcctactaagtgctactatttacgngggcacgtccgtaacccggggngttcccgggggtaccctaggacccgtattcgaggccggtacagggccggggtctggaacgtacgtaagtactttccaacttcctacctaacccaatacgaacgccacgcccgtagacccgagggtctaaggaaagagttggtagggtactaaggtttttaattacgtaggttacaaggtactaggtttaaatttagtaagggtaccgttccctaacgtaacggttacgttttacgggggaccccggggaaaccgtaaggtccgttagggagttacgtaaccaaaacggaacttgggaggcctcggcctaaccg

SEQ ID NO: 435857 - DNA, 580 bp, Homo sapiens
  misc_feature: GZ8MTXP01EBX1Q.38.25.C03.1.454.CMB.2.raw
  modified_base (352)..(352): a, c, t, g, unknown or other
  modified_base (441)..(441): a, c, t, g, unknown or other
  modified_base (503)..(503): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctctgcaaggcttctggttactacttttagctagttatggtgtcgagcgtgggtgcgacacggcccctggacagggtcttggagtggagtgggatggatcagcacttacaagtaggaaacanaaagtatcgacaacagtaactttccgaagggtacaaggagtacatacatcgaccaagacacacacaccgaacgagacactgaccctaanacgtagaaacgtgaacgggaactgacgattcagaccgacgtacggtcttaatattagttggnacgagtaacttaactaactttccttacttaacattaaacgtaccgaacgtaagtgggaattcgttaacctttttaag

SEQ ID NO: 435858 - DNA, 658 bp, Homo sapiens
  misc_feature: GZ8MTXP01DWI2X.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgtccactcccaggttcaattggtgcagtctggagctgcggtgaagaggccgtggggcctcagtgaacgtctctgcaaggcttctggttacacttttagctagttatggtgtcagcgtgggtgcgacacggcccctggacaagggcttgagtggagtgggatggatcgagcactttacaagtaggaaacacgaaagtatcgacactaataactttccgaaagggacaagacgtacaatcatacgaccaacacgacacactccgaacgacgacactcgacctacgagtacggaaacgtaggaacggggtaaaccctggaacgtaacgttccgtacggaacccgtaacgtaacccgggttacctttaagttatttagttcggtaacggtacggaagtaacggttaaacctaaacgtttccccttaaccgtttaacttaacgtttaacgtttaaaccggtaacgtaacgttagggttaaacgtttcggttaacgtttttaacg

SEQ ID NO: 435859 - DNA, 708 bp, Homo sapiens
  misc_feature: GZ8MTXP01D8AQ4.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggagtgggatggatcagcactttaacaagtaggaaaacacgaaaagtatacggacaacaattaaactttcccgaaaggggccaaggagtacaacttaccgatacggaaacccaacaacgaacaaaccactacccgaacgacgacctacttacgaccctaaacgaacgttacgggaaaccttagggaaacgggggtaaacccgttggaaacggtaactttaccgtacggaaccggaaccgtaaaccggggttcccttttaaataacgtttttaagtcggttaacggacgttaagggtaaacgttaaaccgtaaaacttttccccttaaccgtttaacttaacttaacgttaacccggaacgtaagttacgggttaaagtttcggttaacgttttttaaccg

SEQ ID NO: 435860 - DNA, 562 bp, Homo sapiens
  misc_feature: GZ8MTXP01B2KLH.38.25.C03.1.454.CMB.2.raw
  modified_base (411)..(411): a, c, t, g, unknown or other
  modified_base (416)..(416): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggcttctggttacacttttagcagttatggtgtcagctgggtgcgacaggcccctggacaagggcttgagtggatgggatggatcagcacttacaatggaaacacaaagtatacgacacataaattcccaaagggcaagagtcatcatgacacagacacatccaacgagacacgtnaccanagtaggaacaggaacggaactgaagtactcgtagacgacgacgtcttaatattagtgtaagacgaagtaacgaaactaaacttcccttaaccgttacttaacttaacttaacgaacgtagtaggttaacgtaagttaacgtttaag

SEQ ID NO: 435861 - DNA, 735 bp, Homo sapiens
  misc_feature: GZ8MTXP01A2UQL.38.25.C03.1.454.CMB.2.raw
  modified_base (460)..(460): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgacggccccgtggacgaagggcttggagtggagtgggatggatcagcacttacaagtaggaaacacgaaagtatacgacaacgtaataaacgttttcccgaaaaggggtacaaggtacgtaccaagttaccaagttacgaacccaacgaacggacaaaccactacccgaacgganaccaactcgacccttaacgagttaacgggaaacgttacgggaacggggtaaacccgttaggaaacgtacgttaccgtaacggaaaccgaacgtaacccgggttacccttttaaagttaacttttaacgttaggttaacgggaaccggttaaagggtaaacgttaaaccgtaaaaacgttttccccttaaccgtttaaacgttaaactttaaaccgtttaaacggaaaccgttaaggttagggttaaaacgttttcggttaacgtttttttaaccg

SEQ ID NO: 435862 - DNA, 585 bp, Homo sapiens
  misc_feature: GZ8MTXP01C1Q95.38.25.C03.1.454.CMB.2.raw
  modified_base (354)..(354): a, c, t, g, unknown or other
  modified_base (401)..(401): a, c, t, g, unknown or other
  modified_base (410)..(410): a, c, t, g, unknown or other
  modified_base (437)..(437): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatcctttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagcgtgggtgcgacgacggcccctaggacgaagggcttggagtggagtgggatggatcagcacttacaagtaggaaacanaaagtatacgacactaataacttccgaaagggcaagagtacatcaanacgacacanacacacaccagacacactacgaccaanagtacgaacgtaggaacgggtaactagacgacgtacgacgacgacgtacgtacttaatacttagtgtaacgacgagtaacttaactaaaccttccttacttacttaacttaacgtacgaacgtagtaggttagttcgttaactttaag

SEQ ID NO: 435863 - DNA, 666 bp, Homo sapiens
  misc_feature: GZ8MTXP01CAL7A.38.25.C03.1.454.CMB.2.raw
  modified_base (386)..(386): a, c, t, g, unknown or other
  modified_base (401)..(401): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacacggcccctggacaagggcttgagtggatgggatggatcagcactttacaagtaggaaacacgaaagtatacgacactagttaacgttccgggggaacagngtcatcatcgaccanagacacatccacgagccacgtcgacctaacagtacgggaaactagggaacgggaaaccttggaaggtactaccgttaggaacccgtaaccgtaaccggtacccttttaagttaactttagtttacggtggtaacccggtaaaggaaccgtaaaaccttaaaccgttttcccctaacccgttttaaacgactttaaacgtttaacccgggaaacgttaacgttaggggtaaacgtttcggtaacccttttttaaagtttttcccgg

SEQ ID NO: 435864 - DNA, 591 bp, Homo sapiens
  misc_feature: GZ8MTXP01EEUBZ.38.25.C03.1.454.CMB.2.raw
  modified_base (427)..(427): a, c, t, g, unknown or other
  modified_base (436)..(436): a, c, t, g, unknown or other
  modified_base (460)..(460): a, c, t, g, unknown or other
  modified_base (527)..(527): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctaggacgaagggcttggaggtggagtgggatggatcgagcaactttaacaagtaggaaaacaacgaaaagtatacgactaaactaataaactttcccgaaagggtcaagagtcatacaatcgaaccacganacaacaacnccaacgagaccactcgaccctaanagtacggaaactgaacggggaactgaacgtactcgtacgaaccgacaaccggtcttaatattattgngacgagacaactaaacttccttacttacattaagttacgaagtagtaggattgttcttttaacg

SEQ ID NO: 435865 - DNA, 608 bp, Homo sapiens
  misc_feature: GZ8MTXP01EAB1I.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacaggcccctggacgaagggcttgagtggatgggatggatcagcactttaacaagtaggaaacaacaaagtatcgacaataattaaactttcccgaaaggggtccaaggtagtcaaacttacaatacgaaccaacgagaacaacaactacccaacgaacgacactcgacctaacacgtaggaaactacggaacggggaaaccctggaacgtatcgtagaacgacaacggtccttaagtattagttgaagtcgagaacgttactaaacttccttaccttacttataattacgaacgtagtagggttagttcgttaacttttaag

SEQ ID NO: 435866 - DNA, 598 bp, Homo sapiens
  misc_feature: GZ8MTXP01C8FQ6.38.25.C03.1.454.CMB.2.raw
  modified_base (375)..(375): a, c, t, g, unknown or other
  modified_base (410)..(410): a, c, t, g, unknown or other
  modified_base (416)..(416): a, c, t, g, unknown or other
  modified_base (437)..(437): a, c, t, g, unknown or other
  modified_base (556)..(556): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttcgtggttactacttttagctagttatggtgtcagcgtgggtgcgacgacggcccctaggacgaagggcttggaggtggagtgggatggatcagctaacttaacaagtaggaaacaagaaagtatacgacanaataattccgaagggcaagagtcatcatgacaganacacanaccagatacaactgacctaanacgtaggaaactggaacggggtaacctaggaacgtactacgtacgaaccgtacgaaacggtcctttaatagtttagtggtaagacgttagaacgaaactaaacttccttacctttaaanattaacgtacgtaacgtagtaggttagttgttaacgtttaag

SEQ ID NO: 435867 - DNA, 803 bp, Homo sapiens
  misc_feature: GZ8MTXP01BJJT9.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggcgagacgggccaccatcaactgacaagtccagccagtagttgtttacacgagtaccaaacaaataagaattactcgctggaccagcaagaaaccaggacacgtccctacctaagttcgacttactacgtttacgcgggactacgttacccggtaccccgggggtacggttcccccgggggtaccctacggtaccccgtacgtttaccgacgggcccggggtacgtaacggggtcccgggggttactaacgggaacggtaaaccctagggttaccttttaccgaacccttacctaccctaaacccctacgttaaccaacggtaccgaaccggtcccgttacgggaccgtaacggggtaccgttaaggtaaaacgggtagttacgggttacgggttaaccggtttaagtttttaaacgtttaccgttacggttaacgtaacggtacgttaaagtttaaagtttaacgttaacggttaccgttacccgtacgttaacgggttaccgggttttccgggggacccggggttaaccgtaaaggtccggttaagggttacgttaacgtaaccgtaaaacgaacggttacggtacggttaccgtgaacccttaaccg

SEQ ID NO: 435868 - DNA, 716 bp, Homo sapiens
  misc_feature: GZ8MTXP01EFGZE.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacgaagggcttggagtggagtgggatggatcgagctaactttaacaagtaggaaaacaacgaaaagtatacgacaacaattaaacgtttacccgaaaggggtccaaggtaacgtttaccaaagttaccaaagttacggaaaccccaaacgaacgaacctaaacctaactaccccgaacggaacgaccaaccttacggaccccttaacaacgttagggaaaccgttagggaaacggggggtaaaccctggaaacggtactaccgtacggaaccgaaccgtaaccgggtacctttaaagttaacttttagtaggttaacggaacgaagggaacgttaaaccgtaaaactttcccttacccttaagttaaactttaacttaacggtaaccgtaagttagggaaagtttcgttaactttttaacg

SEQ ID NO: 435869 - DNA, 558 bp, Homo sapiens
  misc_feature: GZ8MTXP01EKE7M.38.25.C03.1.454.CMB.2.raw
  modified_base (319)..(319): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaataagaattactcgctaggtaccagacaacgaaaccaggacagccctacctaagtgctctatttacngggctactcgtaccgggagtcccgggtcctgaccgtactcgagcgcacggcggtctgagacagtactttcactctaccaccatcagcacgcctgcagctagagatgtaggtctaaggttttatactggtacagactagttattagtagttacgtcctgaacgttcgtttcggggacccgggttacgaaggcgttggacttacgtaacaaacgtaacgttgacggttctaacgccgtaac

SEQ ID NO: 435870 - DNA, 554 bp, Homo sapiens
  misc_feature: GZ8MTXP01EBD6Q.38.25.C03.1.454.CMB.2.raw
  modified_base (349)..(349): a, c, t, g, unknown or other
  modified_base (419)..(419): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcactttacaatggaaacacaaagtntcgacacataactttccgaagggcaagagtcatcatcgacacagacacactccacgagacactgacctanacgtaggaactggacgggtaacctggaacgtatcgagacgacgacggtcttatattattggaagcgagacgaactaaacttccttaacttcaattaagtaacgaacgtagtagggaaagtcgttaacttttaacg

SEQ ID NO: 435871 - DNA, 671 bp, Homo sapiens
  misc_feature: GZ8MTXP01ESHRM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaagaggccgtggggcctcagtgaacgtctcctgcaaggcgtctggttactacttttagctagttatggtgtcagcgtgggtgcgacgacggccccgtaggacgaagggtcttggaggtggagtgggatgggatcgagctactttaacgaagtaggaaaacaacaaagtactacgactaacgtaagttaaactttcccgaaagggggtacaaggtacgttacaattaccaagttacgaaccctaacaacgaacaacaacgtacccgaacgacgacctaacgttcgaccctaagacgtaggtaaacgtggaaacgggggtaaaccttagggaataacgttacgacggaaccgtaacgtaaccgggttacttaagtacgtttaagtggtaagacgagaaacgttactaaactttcccttaacgttacttattaacgtacgaacgtagtcggttaattcgttaacttttaacg

SEQ ID NO: 435872 - DNA, 793 bp, Homo sapiens
  misc_feature: GZ8MTXP01CXOR5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggcttctggttactacttttagctagttatggtgtcagcgtgggtgcgacgacggcccctaggacgaagggcttgaggtggagtgggatggatcagctaactttaacgaaagtaggaaaacacgaaagtatacgacctaactaagttaaacgtttcccgggggaactaagggtaacgttactaaagttaccgtaaagtaccggaacccaaacgaaacgtaaaccaaccgtaaacgtaccccaaacggtaacgaccctaaaccgttaccggtaccctaaaccgtaaggttaacgggaaaaccgttacgggaaaccggtaaacccgttagggaaacggtaacttacccggtaacggaaacccgaaccgtaaccgggtttaacccttttaaattaacgttttaacgttcgggtaaggaaccggtaaaggaaaccgttaaacccttaaaaccgttttccccttaacccgtttaaaacttacgtttaaacgtttaaacccggaaaccggttaaggttaggggtaaaacgttcggttttaacctttttaacgttttttaaccgg

SEQ ID NO: 435873 - DNA, 530 bp, Homo sapiens
  misc_feature: GZ8MTXP01E0OAH.38.25.C03.1.454.CMB.2.raw
  modified_base (378)..(378): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatcctttttcttggtggcagcagcaacaggtgcccactcccaggttcaattggtgcagtctggagctgcggtgaagaggcctggggcctcagtgaacgtctcctgcaaggcttctggttacacttttagcagtttatgggtgtcagctgggtgcgacaggccccctggacaaggggcttgagtggatggggatggatcagcactttacaatggaaacacaaagtatgcacataaatttcccaaggggcngagtcatcatgaccacagacacatccacgagcaactgccctacatgggaaacctgacggggaacctggacgatctgaccgacacgggccttagtattatgtgcgagacgacaaacttccactttacataatacgaacgattggatgctttaa

SEQ ID NO: 435874 - DNA, 618 bp, Homo sapiens
  misc_feature: GZ8MTXP01EP7YW.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagcagttatggtgtcagctgggtgcgacacggcccctggacaagggtcttgagtggagtgggatggatcgagcacttacaagtaggaaacacaaagtatacgacaacataattccgaaagggacaagagtcatcaatacgacacagacactacaccacgagacactgacctacagtaggaaactggaacggggtaacctaggaacgtacgttcgaacggaaccggtactaaccgggttccctttaaagttatttaagtttggaaggttaccgaagggaacgttaaacgtaaactttcccttaaccgtttacaattaacgtacgtaacgtaagttaggttaaggttcttaacgtttttaacg

SEQ ID NO: 435875 - DNA, 638 bp, Homo sapiens
  misc_feature: GZ8MTXP01EU1MB.38.25.C03.1.454.CMB.2.raw
  modified_base (370)..(370): a, c, t, g, unknown or other
  modified_base (470)..(470): a, c, t, g, unknown or other
  modified_base (586)..(586): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacacggcccctaggacgaagggtcttggaggtggagtgggatggatcgagctactttaacaaagtaggaaaacaacgaaaagtntacgactactaattaaacttcccgaaaggggcaaggtacgtacaactcaagtacgaaccaacgacgacaacactaccgaacgagaccacgtcgaccctanacgtaggaaactggaacgggaactgaacgtactcgagaccgtacgtaccggtccttaagttactttagtgtaacgtacggaaagtacgttaaactaaacgtttcccttaaccttanaacttaagttaccgaacgtagttacgggttaaattcggttaacgtttttaag

SEQ ID NO: 435876 - DNA, 540 bp, Homo sapiens
  misc_feature: GZ8MTXP01BBDX0.38.25.C03.1.454.CMB.2.raw
  modified_base (387)..(387): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaatggaaacacaaagtatcgacacataattccgaagggcaagagtcatcatgacanagacacatccagagacactgacctacataggaactgacgggaactgagatctagacgacacggtccttagtattagtgtgcgagacgaactaaactttccttaccttacattaacgttacgaacgtagtggttaacgttcggttcttttaacg

SEQ ID NO: 435877 - DNA, 628 bp, Homo sapiens
  misc_feature: GZ8MTXP01DLYOY.38.25.C03.1.454.CMB.2.raw
  modified_base (459)..(459): a, c, t, g, unknown or other
  modified_base (583)..(583): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctggacgaagggcttggaggtggagtgggagtggatcgagctaactttaacaagtaggaaaacaacgaaaagtatacgacaataagttaaactttaccgaaagggtacaagacgtacaatacaatacgaaccaacaacgacaacactaccgaacgacgactacncgacctaacagtacggaacgtacggaacggggaacctaggacgtactacgtacgaaccgacgtaccggtaccttaattattattggtaagtacggagtaacgaactaaacttccttacctttanaacttaactacggaacgtagtacggttagtcgttaacttttaacg

SEQ ID NO: 435878 - DNA, 629 bp, Homo sapiens
  misc_feature: GZ8MTXP01EKTJR.38.25.C03.1.454.CMB.2.raw
  modified_base (252)..(252): a, c, t, g, unknown or other
  modified_base (460)..(460): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttacacaggtaccaaanaataagaattactcgctggtacagcaagaaaccagacagcctaccgtaaagttcgctactatttacgtgggacacgttccgtaccccgggggacgttccccgggggtccctaggacccgtacttccgaggccggcgaggcccgggtctggaagactagtactttccaactctaccaccatcagcacgccgtagaccgaggctaggaangtggtgacgttagtttagttacctgtactagactagttattagtagttacgtcccttcgtaacgttaccggttttcggggaccggggttaaaccgaaggtccggttagggacgttaagtaaccgtaaaacggtaacgttcgggtacggttaccgtaacgccctaaaccg

SEQ ID NO: 435879 - DNA, 670 bp, Homo sapiens
  misc_feature: GZ8MTXP01CESSV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacgcggcccctggacgaagggcttggaggtggagtgggatggatcgagtctaactttaacgaagtacggaaacaacgaaagtatacgacaactaattaacttccgaaagggacaagagtacatacaagtacgaaccaacacgaacactacaccgaacgacgactaccgtcgacctaagacgtaacggtaactaggaaacggggtaaccgtagaacgttactacgtacgaaccgtaacgtaaccggtactttaattagtttacgttggtaacgacggttaacgtaaacgttaaccgttaaacctttcccttaaacttacttaaccgtttaagtaaaccccggtaaggtaagttagggttaacgtttcgtttaaccttttttaacg

SEQ ID NO: 435880 - DNA, 654 bp, Homo sapiens
  misc_feature: GZ8MTXP01D2TJK.38.25.C03.1.454.CMB.2.raw
  modified_base (570)..(570): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttgttttacacaggtaccaaacaataagaattactcgctggtaccagacaagaaaccagacagaccctacctaaagttcgacttactaatttacgtgggacctaacgtacccgtaaccccgggggtacggttccccgggggtccctacggacccgtaacgtttccgacggcccgggtacacgggtccggggttcctgggacgtaaccgtaggtactttccgaccttctacccaaccactacgaacgcacgccctgacgaaggtctaggaagaattgggtacgacgtttaacggtttattaccgtgtacagtactagttattaagtagttacgtcctnaaggttacgtttcggggaccgggggttaacaaggtcgttaggacgttaactaacgtaaacgtaacgtgtaggctcgcctaaccg

SEQ ID NO: 435881 - DNA, 628 bp, Homo sapiens
  misc_feature: GZ8MTXP01BWID0.38.25.C03.1.454.CMB.2.raw
  modified_base (446)..(446): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacacggcccctggaaccgaagggcttggagtggagtgggatggatcagctacttaacaagtaggaaaacaacgaaaagtatacgacaacgtaattaaacgttcccgaaaggggacaaggtatacaatacactacgaaccacaagacaacactaccaacganaccaactgaccctagagtacggaaacgtaggaacggggtaaacctggaaacgtacgttacgaacgaccgtaacgtaaccggttacctttaaagtatttagtggtaacgacgaagaacttaactaaacttccttacttaacattaataccgaagtagtaggttaagttcgttaacttttaacg

SEQ ID NO: 435882 - DNA, 723 bp, Homo sapiens
  misc_feature: GZ8MTXP01DPM66.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactactttttagctagtttatggtgtcagcgtgggtgcgacgacggtcccctggaacgaagggtcttaggaggtggagtgggatggatcgagctaactttaacaaagtaggaaaaccaagtaaaagtatacgactaaactaattaaactttcccgaaaggggacctaaggtacgtacaaattaccaagtacggaacccaaacgagaaacccacaacctaccgaaaccggtacgaacctaaccgttacgaaccccttaagaaaccgttagggaaaacgttcgggaaacggggtaacccgttagaagtacttacgacggaaccgaccgtaacggttaccttaaattacttaacgttggtaacgtacggaaaggtaacgttaaacgttaaacctttacccttaaccgtttaacgttaacttaaacgttaccggtaacgtaaggtacggttaaacgtttgttaacgttttttaaccg

SEQ ID NO: 435883 - DNA, 645 bp, Homo sapiens
  misc_feature: GZ8MTXP01APL7H.38.25.C03.1.454.CMB.2.raw
  modified_base (398)..(398): a, c, t, g, unknown or other
tcagtcgatcacgtcacgaccggtgctcgatttagtagtgtagatttgggtttgggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctggtggcgacaggcccctggacaagggcttggagtggatggggatggatcagcacttacgaataggaaacacaaagtatcgacaacattaattccgaagggcaagagtcatcatcgaaccanacgacacactccaacgagaccaacgttcgacccttaacgacgtacgggaaacctagggaacgggggtaaacccttgggtaacgacttaccgtacgaacccgtaaccgtaccgggtaccctttaagttacttaacgttggtaagaaccggagaacggaaaccttaaacgtttccccttacgtttaaccagtttaaacgtttaaccggaacgtaagttacgggttaaggttcgtttaaccgtttttaag

SEQ ID NO: 435884 - DNA, 684 bp, Homo sapiens
  misc_feature: GZ8MTXP01AYJRZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttaggagtggagtgggatggatcagcaactttacaataggaaacaactaaagtatcgacaactaagtaatttcccgaaagggtcaagtagtacaatcgatacgaacctacacgaccaacactacccaacggagaccaacgttcgaccctaacgacgtagggaacttacgggaacggggtaaacccgttaggaaacgtaacttcgtaacggaaccggtaaccgtaccgggttacctttaagttaacgtttaacgttcggtaaggtaccgggttaaagtaacggttaaaccgttaaaacgtttccccttaaccgtttaacgttaacttaacgttaaacggaacgttaaggtaggggttaactttcgggttaactttttaacgg

SEQ ID NO: 435885 - DNA, 691 bp, Homo sapiens
  misc_feature: GZ8MTXP01BQZ8G.38.25.C03.1.454.CMB.2.raw
  modified_base (337)..(337): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctggacaagggcttgagtggagtggatggatcagcaacttanaagtaggaaaacaacaaaagtatacgactaacgtaattaaactttcccgaaaggggtaccaaggaacgttacaattcaagtacgaaacccaacgaacgaaccaactactacccgaacgacgacctaacgtcgaccctaacgaacgtacgggaaacttacgggaaacggggtaaaccttaggaacgtacgtacgtacggaaccgtaacgtaaccgggtacctttaagttaactttagttggtaagtaccggttaaaggtaaacgttaaaccttaaaacgtttcccttaaccctttaagttaactttaacgttaacggtaacgtagtacgggttaaagttcgttaacctttttaag

SEQ ID NO: 435886 - DNA, 582 bp, Homo sapiens
  misc_feature: GZ8MTXP01A98US.38.25.C03.1.454.CMB.2.raw
  modified_base (420)..(420): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacaggcccctggacgaagggcttgagtggagtgggatggatcagcactttacaaataggaaaacacaaaagtatgacaactattaaatttcccgaaggggacaagagtcaatcatacgaccaacacgaacacaacnccaacgagacactgacctacagtaggaaactggaacggggaaacctggaacgactcgacgacgacacggtccttaatattagtggtaagacggagaacaactaaacttcccttaccgttacttattaattacgaacgtagtaggaagttcgttcgtttttaa

SEQ ID NO: 435887 - DNA, 602 bp, Homo sapiens
  misc_feature: GZ8MTXP01D3UAA.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactccccaggttcaattggtgcagtctggagctgcggtgaagaggcctggggcctcagtgaacgtctcctgcaaggcttctggttactacttttagctagttatggtgtcagctgggtgcgacaggccctggacaagggcttgagtggagtgggatggatcgagctacttacaataggaaacacaaagtatcgacacaataactttcccgaaagggtcaagtagtcatacatacgacacagacacactaccacgagaccactcgacctacgatacgggaaactcggaaggggtaacccgtggaagacttcacggaaccgaaccgaaccggttcctttaattacgtttattggtcgagttagaacgttaactaaactttcccttacccttattaacttaattaacgcgtaagtggttaaagttcgttaacgtttttaacg

SEQ ID NO: 435888 - DNA, 678 bp, Homo sapiens
  misc_feature: GZ8MTXP01DYKOD.38.25.C03.1.454.CMB.2.raw
  modified_base (341)..(341): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggtcttctggttactacttttagctagttatggtgtcagcgtgggtgcgacacggcccctggacaagggtcttgagtggagtgggatggatcgagcactttaanaagtaggaaacacaaagtatacgactaactaattaactttacccgaaaggggacaaggtagtacaacttacaagtacgaacccaacagaaccaacactccgaacgaagacctaccgttacgacccttaaagagtacggaaacgtacggaaacggggtaacgtaggaacgtacgtacgacgaacgtaaccgtaaccgttctttaagttagttagtggtaacgacggttaaggtaaacgttaaaccttaaactttacccttaaccgtttaacttaacgtttaacgttaaaccggtaagttaacgggtacggttaacgtttcgtttaaccgtttttaacg

SEQ ID NO: 435889 - DNA, 516 bp, Homo sapiens
  misc_feature: GZ8MTXP01DXB87.38.25.C03.1.454.CMB.2.raw
  modified_base (388)..(388): a, c, t, g, unknown or other
  modified_base (496)..(496): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacaagggcttgagtggatgggatggatcagcacttacaataggaaacacaaagtatgacacataatttccaagggcaagagtcatcatgaccanagacacatccagagacactgcctacatggaactgacgggaactgagatctgacgacacggtcttatattatgtgcgagagactaaattccttacttacataattacgngtatgggattgttcttttaa

SEQ ID NO: 435890 - DNA, 642 bp, Homo sapiens
  misc_feature: GZ8MTXP01BPIO7.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttacacttttagctagttatggtgtcagcgtgggtgcgacacggccccgtggacgaagggcttggagtggagtgggatggatcagctacttacaagtaggaaacacgaaagtatacgacactaattaactttcccgaaaggggaccaaggagtaccaattaccaatacgaaccaacgagaaccaactaacaccgaacgacgaccaacctcggaccctaacgagtacgggaaacgtacggaaacgggggtaacctaggaacgtactccgtacggaaccgaaccgtaccggtacctttaagtatttagttggtgacgttaagtaacgaaaccttaaacttcccttacttaacattaacgtacgtaacgtagtagggttaacttcgttaacttttaacg

SEQ ID NO: 435891 - DNA, 528 bp, Homo sapiens
  misc_feature: GZ8MTXP01C2MEI.38.25.C03.1.454.CMB.2.raw
  modified_base (412)..(412): a, c, t, g, unknown or other
tcagtcgatcacgtcacgaccggtgctcgatttagtagtgtagatttgggtttggggacccaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcactttacaatggaaacacaaagtatcgacacataattccaaagggcaagagtcatcatgacacagacacatccacgagcactgcctanatacggaactggacgggaacctgagatcagacacgacgcttatattatgtgcgagtacgaactaaacttccttaccttacacttaataacgaacgtatggaagtgttcttttaacg

SEQ ID NO: 435892 - DNA, 678 bp, Homo sapiens
  misc_feature: GZ8MTXP01AWBQS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacaggcccctggacaagggcttgagtggagtggatggatcgagctacttaacaagtaggaaaacacgaaagtatacgacaactaattaactttcccgaaagggacctaaggtacgtaccaattacaatacggaaacccaacgaacgaaccaacaacgtaccgaacgacgaccaacctacgaccctaacagttaacggaaaccttaggaaacggggtaaacctaggaactacgtaccgtacggaacgtaacgtaaccgggttacctttaagttaatttagttgtaacggtaacgaaaggtaacgttaaaccttaaaacgtttccccttaacgtttaacaactttaacgttaacccgtaagtaacgtagggttaactttcggttctttttaacg

SEQ ID NO: 435893 - DNA, 703 bp, Homo sapiens
  misc_feature: GZ8MTXP01C6WNL.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacacggcccctggacgaagggcttgagtggatgggatggatcgagctacttacaagtaggaaacaacgaaagtactcgactaactaattaaactttcccgaaaggggacctaaggtagtacaattacaacgtcgaaacccaacaagaaccaacctaactccgaaacggacgacctaaaccgtcggtaacccctaacgaagttacgggaaactacgggaaacggggtaaaccctggaaacgtaacgtaccgttaacggaacccgaacgtaacccggtacctttaataacgtttaagtttcggttaacggacggaaacgtaacgttaaaccgttaaaacctttcccgttaaaccgtttacttaaacgtttaacttaaccggaacgttaaggtaggttaagtttcggttcttttttaaccg

SEQ ID NO: 435894 - DNA, 558 bp, Homo sapiens
  misc_feature: GZ8MTXP01ACR39.38.25.C03.1.454.CMB.2.raw
  modified_base (366)..(366): a, c, t, g, unknown or other
  modified_base (539)..(539): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacgacggcccctggacgaagggcttggaggtggagtgggatggatcagcacttacaagtaggaaacacaaagtatcgacanataacttccgaagggtcaagagtcatcgatcgacacagaacacactaccgaacgagaccactcgacctaacagtaggaactaggaacggggaacctgacgatcgtgacgacgacggtcttatattagtggtgacgagagaactaaattccttacttacataatacgaacgtanaggttatgttaactttaag

SEQ ID NO: 435895 - DNA, 558 bp, Homo sapiens
  misc_feature: GZ8MTXP01EVTNM.38.25.C03.1.454.CMB.2.raw
  modified_base (489)..(489): a, c, t, g, unknown or other
  modified_base (519)..(519): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaagtaggaaacacaaagtatacgacaactataactttcccgaaaggggcaagtagtcatccaatcgaaccacacgaacacactccaacgagacactcgacctacagtggaactgaacgggactgaagatctgacgacacggtacttatattattggngacgagagttaactaaacttccttacttanataattaaccgaagtagtaggattcgttaacttttaacg

SEQ ID NO: 435896 - DNA, 585 bp, Homo sapiens
  misc_feature: GZ8MTXP01BYJCS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacgaagggcttgagtggatgggatggatcagcacttacaatggaaacacaaagtatcgacataataattaccgaagggcaagagtacatcatcgacacagacacatccaacgagacaactcgacctaacagttacggaaactaggaacggggaaacccttaggaacgtaactccgtaacggaaccgaaccgtaaccgggtaccctttaaagttattagttgtcgacgttaagaacgttactaaacttccttacgttacattaatacgaatatggaatgttcttttaag

SEQ ID NO: 435897 - DNA, 787 bp, Homo sapiens
  misc_feature: GZ8MTXP01CH8ZM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgaggccccgtggacgaagggtcttggagtggagtgggatgggatacgagactaactttaacgaagtacggaaaactaacgtaaaaggttacttacggactaaatttaacgtttaaaacgttttccccggaaaaggggggtacctaagggtaaacggttacctaaacggtttaccaaacgttaccgggaaacccaaaccgtaacggaaaccctaaacccaaaccgttaccccgaaacgggaacgaccctaaccgttacggaccccttaaacgaacgttaacggaaaccgttacgggaaacgggggtaaacccttaggggaactaacgttaccgagggaaacccgtaacgtaaccgggttacctttaaaggttaactttaacgtttggaaggttaccgaaagggtaaccgaaacgttaaaaccgtttcccttaaccgtttaacttaacgttaacgtttaacgaacggttagtacgggttaaaggtttcgtttaacgttttaag

SEQ ID NO: 435898 - DNA, 733 bp, Homo sapiens
  misc_feature: GZ8MTXP01BZ5Z7.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagtcgtgggtgcgacgacggccccgtaggaccgaagggtcgttagaggtggagtgggatggatcgagtactaactttaacgaaagtacggaaaacaacgaaagttactacgacctaactaagttaaacgtttacccgaaaggggtacctaaggtacgtaccaagttaccgaacgttacgaacccaaacgaacgaaccaaccgtacgtacccgaacggacgaccctaaccgtaccgtaccctaaacgtacgtaacgggaaaccgttacgggaaaccggggtaacccgttaggaacgtaacgttaccgtaacggaaccgtaaccgtaaccggttacctttaagttaacgtttagttggtaacggacgttaaagtaaacgttaaacttaaacctttacccttacccgttattaacgttaagttacgaacgtagtaggttaacgttcgtttaacttttaacg

SEQ ID NO: 435899 - DNA, 624 bp, Homo sapiens
  misc_feature: GZ8MTXP01BRTF1.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagcgtgggtgcgacaggcccctggacgaagggcttgagtggagtgggatggatcagcacttaacaaagtaggaaaacacaaagtatcgacaacgaattaaatttcccgaaaggggcaaggacgtacaagttcaatacggaacccacaagaaccaacactacccgaacgacgaccacttcgacctacagtacggaaactggaacggggtaaccgtgaacgactcgtacgaccgtacgaaccggtacctttaagtatttagtgtaagacgagtaacgaactaaactttcccttacgttaacttacttaacgttacggtaacgtaagtacgggttagtcgttaactttttaacg

SEQ ID NO: 435900 - DNA, 680 bp, Homo sapiens
  misc_feature: GZ8MTXP01CM7HS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggcttctggttactacttttagctagttatggtgtcagtcgtgggtgcgacgacggcccctggacgaagggtcttggaggtggagtgggatggatcgagcacttaacaataggaaacacgaaagtatacgacaactaattaaacgtttccgaaacggggtacaaggacgttacaaattacgaagtacgaaacccaacaagaaccaacaactaccacgaagacctacgtacggaccctaacgaacgttacgggaaaccgttaggaaacgggggtaaacccttaggggaaactacgtaccgtacgaacccgaacgtaaccggtaacctttaagttaatttacgttgtaacgagaaaggtacttaaaccgtaaactttacccttaccgtttaacaagtttaacgttaaccgaacgttaagaggttaacgtttcggttaactttttaag

SEQ ID NO: 435901 - DNA, 565 bp, Homo sapiens
  misc_feature: GZ8MTXP01DE5R6.38.25.C03.1.454.CMB.2.raw
  modified_base (250)..(250): a, c, t, g, unknown or other
  modified_base (436)..(436): a, c, t, g, unknown or other
  modified_base (486)..(486): a, c, t, g, unknown or other
  modified_base (522)..(522): a, c, t, g, unknown or other
  modified_base (549)..(549): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactcccctggctgtgtctctgggcgagagggccaccatcaactgcaagtccagccagagtgtttacacaggtccaaanaaataagaattacttcgctggtaccagcaagaaaccaggacagcctcctaaagttgctctatttaactgggctagtccgtacccggggagttcccgggggtccctggaccgtacttcgaggcggcgacggcgggttctggagacagtatttccactctcaccatcagcagcctgcaggctgaaagntgtaggtctaagtttattaacgtgtacagctagttattatagtagtcctnaagtcgtttggaccgggggacctaaaggcgttaggngttaacgtaacgaaaacggtaactggnggttctcggctaaccg

SEQ ID NO: 435902 - DNA, 748 bp, Homo sapiens
  misc_feature: GZ8MTXP01C4865.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttctggttacacttttagctagttatggtgtcagctgggtgcgacacggcccctggacgaagggcttggagtggagtgggatggatcgagctaactttaacaagtaggaaaacaacaaagtatacgacaactaattaaacgtttaccgaaagggggactaaggtaagtaccaattaccaagtacggaaacccaaacgacgaacctaaacctactaccccgaacggaacgacctaaccgttcggaccccttaacgaacgttaacgggaaaccttacgggaaacggggtaaaccctaaggtaacttccgtaaggaacccgtacgtaaccgggttacctttaattaacgtttaagttcggtgggtaaccgaaaggttaaacggtaaacccttaaaacgttttccccttaaccttttaaaccttaaacgtttaacttaaacccgggtaaacggtaacggtttaacggggtaaagttttccggttaaccgttttttaacgttttttaacccggg

SEQ ID NO: 435903 - DNA, 652 bp, Homo sapiens
  misc_feature: GZ8MTXP01CTEJM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttctggttactacttttagctagttatggtgtcagtcgtgggtgcgacgacggcccctggacgaagggcttggaggtggagtgggatggatcagctaactttaacaagtaggaaaacaacaaagtatacgacaactataaacttccgaaagggcaagagtacatacatacgacacagacacactaccacgagacactcgacctacgagtaggaaacttacggaacgggggtaacctggaacgtactacgacggaaccgaaccgtaaccggtacctttaattagtttacgttggtaacggtacggaaagtaacgttaaaccgttaaactttccccttaaccgttaacttaactttaaacgtttaacccggaacgttaaggttagggttaaacgtttcgttaacgttttttaacg

SEQ ID NO: 435904 - DNA, 571 bp, Homo sapiens
  misc_feature: GZ8MTXP01BQ0CO.38.25.C03.1.454.CMB.2.raw
  modified_base (409)..(409): a, c, t, g, unknown or other
  modified_base (431)..(431): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcactttacaatggaaactacaaagtatacgacaactataatttccgaaagggacaagagtcattcatcgaccacagacaacanaccaagagacactgaccctaanagtacgaactgaacgggtaactgagactcgacgacgacgtaccgtacttattattacgtgtaagacgagacaacgtaaacttccttacttacttaacttaacgtacgtaacgtagtaggttacgttcgttaacgtttaag

SEQ ID NO: 435905 - DNA, 701 bp, Homo sapiens
  misc_feature: GZ8MTXP01A2QD0.38.25.C03.1.454.CMB.2.raw
  modified_base (376)..(376): a, c, t, g, unknown or other
  modified_base (461)..(461): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaaggaggccgtggggcctcagtgaacgtctcctgcaaggtcttctggttactacttttagctagttatggtgtcagcgtgggtgcgacgcggcccctggacgaagggcttggaggtggagtgggatggatcgagctactttaacgaagtaggaaaacacaaagtatacgacaanattaacttcgaaagggacaaggacgtacatacatacgaaccacacgaacaccaactcccgaagacgaccacgtacgcccctaaanacgtaggaaactcggaaacggggtaaccgtaggaacacgtacgtacggaaccgaacgtaccggttacctttaagttaacgtttatttccggtaaggaccggttaaaggtaaacgttaaaccctaaaacggttttcccccttaacccgtttaaattaaacgtttaaaccgtttaaacccgggtaaacgtaacggtttaaggggttaaacggtttcggttaacctttttttttaaacccggg

SEQ ID NO: 435906 - DNA, 536 bp, Homo sapiens
  misc_feature: GZ8MTXP01BFK5L.38.25.C03.1.454.CMB.2.raw
  modified_base (379)..(379): a, c, t, g, unknown or other
  modified_base (394)..(394): a, c, t, g, unknown or other
  modified_base (442)..(442): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacgaagggcttgagtggatgggatggatcagctaacttacaagtaggaaacacaaagtatcgacacaataacttccgaaagggcngagtcatcatgacanagacacatccagagacactgacctacatggaactgaacgggaactganatcagacgacgacgtcttatattattgaagcgagaagttaactaaacttccttaccttacataattacgaacgtataggaatgttaactttaag

SEQ ID NO: 435907 - DNA, 745 bp, Homo sapiens
  misc_feature: GZ8MTXP01C4B0L.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctgttactacttttagctagttatggtgtcagcgtgggtgcgacacggccccgtaggacgaagggcttggagtggagtgggatggatcgagctaactttacaaagtaggaaaacaacaaagtatcgacaactaattaaactttcccgaaaggggtacaaggtacgtacaaagttacaacgtacggaaccaaacagaaaccacaactacccgaacgaacgaccaaacgttcgacccttaaaccgaagttacgggaaaacgttacgggaaacgggggtaaacccttagggtaagaacgtttaccgtaacgggaacccggaaccgtaacccggggttaccttttaaagtttaactttaacggtttaggtaacggtaaccggttaaaggtaaacggaaacctttaaaacgttttcccctttaaacccgtttaacttaaacgtttaacgtttaaacggtaaccggtaacggttaggggttaacggtttcgtttaacccttttttaacg

SEQ ID NO: 435908 - DNA, 801 bp, Homo sapiens
  misc_feature: GZ8MTXP01CBOU6.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacactttttagctagttatggtgtcagcgtgggtcgcgacacggccccgtaggacgaagggcttggaggtggagtgggatggatcgagactaactttaacgaaagtaggaaactaacgaaaaggtatacggacaaactaattaaacgtttacccgaaagggtaccaaggaaacggttaccgaaattaccgtaaactacgggaaaccccaaacgaaccggaaaccctaaacgaaaccgttaacccaaaccgggaaacgaaccctaaccgttacggaaccccttaaaccaaggttaacggaaacgttacggaaacggggtaaacccgttaaggaacgtaacgttaccgttaacggaaacccgtaaacgtaacccgggttaaccctttaaagttaactttaagttttagggaacgttaaccgggaggtaaaacgttaaaccgttaaaaaccgtttcccctttaacccgtttaaacgttaaacttttaaacgttaaacccggtaaacggttaacgttaacgggggttaaaaggttcgtttaaccctttttttaacgg

SEQ ID NO: 435909 - DNA, 575 bp, Homo sapiens
  misc_feature: GZ8MTXP01EBVSV.38.25.C03.1.454.CMB.2.raw
  modified_base (360)..(360): a, c, t, g, unknown or other
  modified_base (381)..(381): a, c, t, g, unknown or other
  modified_base (395)..(395): a, c, t, g, unknown or other
  modified_base (401)..(401): a, c, t, g, unknown or other
  modified_base (526)..(526): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacacggcccctggacaagggtcttgagtggatgggatggatcagcactttacaataggaaacacgaaagtatcgacanaataacgttccggggaacagngtcatcatgaccanagacanactccagagcactgacctagacgtaggaactagaacggaaccgtgaagtacttacgagaaccgacacggtacctttaagtattagttggtcgaacgtagaagtacttaaacttcctaccttattnttaactttaacgaacgtaagtagggattgttaaccttttaagttttccg

SEQ ID NO: 435910 - DNA, 590 bp, Homo sapiens
  misc_feature: GZ8MTXP01A29OJ.38.25.C03.1.454.CMB.2.raw
  modified_base (548)..(548): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagctgggtgcgacacggcccctggaccgaagggcttagagtggagtgggatggatcagctacttaacaagtaggaaaacacaaagtatacgacaataataaactttccgaaagggacaagagtcaatacatacgaaccaacagaacacatccgaacgagacactcgacctacataggaacgtgaacgggtaactggaagactcacggaccgacgtaaccggtcttaatactttatgtaacgacgagaacgttaactaaacttcccttacgttaanacttaagtaccgaagtagtaggttaattgttaacttttaacg

SEQ ID NO: 435911 - DNA, 631 bp, Homo sapiens
  misc_feature: GZ8MTXP01C5XRW.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacaggcccctggacaagggcttgagtggatgggatggatcagcactttaacaagtaggaaaacacaaagtatacgacaactattaaactttccgaaagggggtacaaggagtcaatcatacgaccacacgtaacacactaccacgagacacgtgaccctacagtcggaaactcggaaggggaaacccgtgaagtactcgtacgaccgtaacgtaacgggtcctttaaagttatttagttgggtaacgacggttaaggtaacgaaaccttaaaactttcccttaaccgttacttaaacttaacgtttaaccgaacgttaagttagggttaacttggttctttttaacg

SEQ ID NO: 435912 - DNA, 748 bp, Homo sapiens
  misc_feature: GZ8MTXP01AU79X.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcgagcgtgggtgcgacgacggcccgtggacgaggtcgttgagtggatgggatggatcagactaactttacaagtacggaaaactacgaaaagttacgtacgactaacgtaacttaaacgtttcccgaaaaggggtaccaaggtaacgttacaaacttaccgaacgttaacggaaaccctaaacaaacgtaacctaaaccgaacctacccgaaccgaacggtacctaaacgtaccgtaacctaaaccgtaagttaaccggtaaacgtacgggaaacggggtaaaccggttaacggaagtacgttacgaacgaaccgaccgtaaccggttacctttaagtaactttagttcggtaacgaacggttaaacggaacgttaaccttaaaactttcccctttaaccgttaaacgttaaccttaaacgttacccggaaacggttacgttagggttaaacgtttcgttaacgttttttaaccg

SEQ ID NO: 435913 - DNA, 617 bp, Homo sapiens
  misc_feature: GZ8MTXP01CQXO4.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgtttacacaggtccaaacaataagaattacttcgctgtaccagcagaaaccaggacagcctcctaaagttgctcaatttactgggcaatcctaccccgggagtccggggtccctgaccgtactcgagcggcacggacggtctgacgtacagtattactactactacacaactacacgacgacgccgtcgacgacgacgtagaagaagtagtacggtacggtaagtttaagtttacgttacgtacgtacgacgtaagttaagttaacgtagtacgtacctacgtaacgtacggtttacggggtaccgggggaaccggtaaacggtacgttacggttacgaacgtaacgtaaaacgtaaacgtacggtacggttacgtcgaacgtaacg

SEQ ID NO: 435914 - DNA, 590 bp, Homo sapiens
  misc_feature: GZ8MTXP01C2M04.38.25.C03.1.454.CMB.2.raw
  modified_base (263)..(263): a, c, t, g, unknown or other
  modified_base (316)..(316): a, c, t, g, unknown or other
  modified_base (378)..(378): a, c, t, g, unknown or other
  modified_base (442)..(442): a, c, t, g, unknown or other
  modified_base (547)..(547): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggcgagagggccaccatcaactgcaagtccagcagagtgtttacacaggtccaaacaataagaattactcnctggtaccagcaagaaaccaggacagccctactaaagtcgctactatttacgngggcaacttccgtaacccgggggagtcccgggggtccctaggacccgtacttccgagccggnacggcgggtctgagactagtactttccactctacaccatcaagcagccctgcaggctagaaagntagtggactaggtttacttagtgtacagctaagttatttaagtgtaactcccgtataagggttaaccgtttcggggaccgggttaaccgaaaggtcgttaggganacggttaacaaaacggtaacgttggacggttctggcctaaccg

SEQ ID NO: 435915 - DNA, 628 bp, Homo sapiens
  misc_feature: GZ8MTXP01DGB65.38.25.C03.1.454.CMB.2.raw
  modified_base (348)..(348): a, c, t, g, unknown or other
  modified_base (440)..(440): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgagtggagtgggatggatcagcactttaacaagtaggaaacanaaaagtatagacaactaataaactttcccgaaagggtcaagagtcaatcaatcgaaccacagacacataccacgagacaactgaccctaaanagtaacggaactaggaacgggtaacgtagaacgtacgtacgtacgaaccgtaacgtaccgtacttaattagttacgttggtaacgtaacggaacgtaaacgttaaaccgttaaaccttcccttaaccttaacgttaaacttaacgtaacgtaacgtaaggtacggttaagttcgtttaacgtttaacg

SEQ ID NO: 435916 - DNA, 665 bp, Homo sapiens
  misc_feature: GZ8MTXP01BQF9A.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacacggccccgtggacgaagggcttggagtggagtgggatggatcgagctacgttaacaagtaggaaaacaacaaaagtatacgactaacaattaaacgtttcccgaaagggacaaggtacgtacaatcaagtacggaaacccaacacgaacaacactacccgaacgagaccaacgtcgacctaacgacgttcggaaacgttggaaacggggtaacccgttaggaacgtaacgttaccgacggaaccgtaaccgtaaccggttaccttaaagttaactttaagttggtaacgaaccgttaggaaacttaaccgtaaactttcccttacgttacttattaacgtacgaacgtagtaggttaacgttcgttctttttaacg

SEQ ID NO: 435917 - DNA, 538 bp, Homo sapiens
  misc_feature: GZ8MTXP01AG27R.38.25.C03.1.454.CMB.2.raw
  modified_base (309)..(309): a, c, t, g, unknown or other
  modified_base (423)..(423): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttacacaggtccaaacaataagaattactcgctggtaccagcagaaaccaggacagcctctaagtgctcatttacngggcatcgtaccgggagtccgggtcctgaccgattcagcgcagcggtctgagacagattcactctcacatcagcagcctgcaggctgaagatgtggctagtttatactgtcagnagtattatagtacgtctgtaagtcgttttggggaccgggggacctaaagtcgttagggacgaacggttaaccaaaacggtaaccttgggacgggttaccttgggcccgtaacccg

SEQ ID NO: 435918 - DNA, 676 bp, Homo sapiens
  misc_feature: GZ8MTXP01DKTER.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagtcgtgggtgcgacgacggcccctggacaagggtcttgagtggagtgggatggatcgagctaactttaacaaagtaggaaaacaacgaaagtatacgacaactaattaaactttcccgaaaggggacaaggaagttacaattacaagtacgaaacccaacaacgaacaacaactaccaacgagaccactcgaccctaacgagtacggaactaggaacgggggtaacctaggaacgtacgttaccgacggaaccgtaaccgaccgggttacctttaagttaactttaagttggttaacgaccgttaaaggtaaacgttaaaccgtaaaacgtttcccttaccgttaacttaacttaacgtaaccgaacgtaggtaggttaacgttcgttaacgtttttaacg

SEQ ID NO: 435919 - DNA, 786 bp, Homo sapiens
  misc_feature: GZ8MTXP01BJ0YO.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggccctggacaggcttggagtggatgggatggatcgagctaacgtttaacaaagtacggaaaacaacgaaaaggtactacggactaaacgtaattaaacgtttcccgaaaagggggacctaaggtaacgttaccaaagttaccaagtacgaaacccaaacgaacgaaccaaccaaacgtaccccgaaacggaacgacccgtaacttacggaaccccttaaccaaggttaacgggaaacgttacggggaaacggggtaaaccccgttaggaaaccggtacgtttaaccggtaccggaaacccggtaaccggtaaaccccggggtttaacccttttaaacgtttaaacgttttaacggttgggttaacgggaaacgggttaaacgtaaacgggttaaaacccgttaaaactttaccccttaaccgttttaacaaacgtttaaccgttaaacggaaccgttaaggtaggggttaaacgtttcggttaaccttttttaaaccg

SEQ ID NO: 435920 - DNA, 641 bp, Homo sapiens
  misc_feature: GZ8MTXP01AXHMN.38.25.C03.1.454.CMB.2.raw
  modified_base (352)..(352): a, c, t, g, unknown or other
  modified_base (588)..(588): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactactttttagctagttatggtgtcagcgtgggtgcgacaggcccctggacaagggcttgagtggagtgggatggatcgagcacttaacaagtaggaaacanaaagtatcgacaacgtaataacgtttccgaaagggtccaagagtacaacgtacacgtacgaacccaacagaaccacaactacccgaagacgaccaccgtgaaccctacgaagtacggaaacctaggaacggggtaacctaggaagtacgtacgtacgaaccgtacgtaacggtcctttaatagtttagtcggtaagacgaacggtaattaaacctaatttcccttaacccgtttanactttaacgtaacgtaacgtaagttagggttaagttcggttaactttttaacg

SEQ ID NO: 435921 - DNA, 589 bp, Homo sapiens
  misc_feature: GZ8MTXP01BHTLV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatgggtgtcaggctgggtgcgacaggcccctggacaagggcttgagtggatgggatggatcagcacttacaataggaaacacaaagtatcgacacataattccgaagggtcaagagtcatcagtacgaccaacacgaacacctatacccgaacgacgccaactacgccctaacagtacggaacgtagaacgggggaacctaggagactctagaccgactaacggtcctttaatattatgtgtacgaggaacacgtaaaacttcccttacttacttacttaacgttacgaaccggtataggttaaacgttgttaacgtttttaacg

SEQ ID NO: 435922 - DNA, 611 bp, Homo sapiens
  misc_feature: GZ8MTXP01EZGW0.38.25.C03.1.454.CMB.2.raw
  modified_base (356)..(356): a, c, t, g, unknown or other
  modified_base (492)..(492): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacacggcccctggacgaaggcttgagtggatggatggatcagcacttaacaagtaggaaacacgaaaagtntacgacaactaattaactttcccgaaaggggacaaggtactacaattccaagtacgaacccaaacgagaaccaacaacaccgaacggagtaccactcgacctaacagtacggaaactaggaacgggaacctagganacttacgacgaacgacgtaacggtcttaatagttatggtaacgcgaaaggacttaaactaaacttcccttacttacttaattaactaccgaacgtgtagggaattcgtttcttttaacg

SEQ ID NO: 435923 - DNA, 624 bp, Homo sapiens
  misc_feature: GZ8MTXP01AP66D.38.25.C03.1.454.CMB.2.raw
  modified_base (288)..(288): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcaggctggggtgcgacncggccctggacgagggcttggagtggatgggatggatcagctaattacgaagtaggaaaacaacgaaagtatacgacaataattaattccgaaagggcaagacgtacaatcatcgaaaccacaacgacaacactacccaagacgacacgtacgaccctaagatacgggtaaactagggaacggggtaaaccctggaaacgattacgagaccgacgtaaccggtcctttaagtacttaagttggtcgtaacgacggtaaacgttaacctaaacgtttccccttaccgtttacaacttaacgtaccgaagtagtagggttaattgttaaccttttaag

SEQ ID NO: 435924 - DNA, 721 bp, Homo sapiens
  misc_feature: GZ8MTXP01CJJIM.38.25.C03.1.454.CMB.2.raw
  modified_base (670)..(670): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctggcggtagaaggaggccgtggggcctcgagtgaacgtctcctgacaaggcttcgtggttactacttttagctagttagtggtgtcaggcgtgggtgcgacgacggcccgtggacgagggcttggaggtggagtggatgggatcgagactaactttaacgaaagtaggaaacaacgtaaagtatacgactaaactaagttaacgttaccgaaaggggtacaaggacgttacaagtcaacgtacgaaacccaacgaacgaaccaactaacgtacccgaaacggtaacgacccgtaaccgttacggaccctaaacgtaacgttaacgggaaaccttacgggaaacgggtaaacccggtaggtacgtaacgtaccgtacggaaccggtaaccgtaacggtttaccttaagttaagtttagtacggttaacggacgttaaaggtaacgaaacctttaaactttcccgttaaaccgttanaacgtttaacgtaacgtaagtaagttacggaagtttcgttaactttttaag

SEQ ID NO: 435925 - DNA, 632 bp, Homo sapiens
  misc_feature: GZ8MTXP01DA6RM.38.25.C03.1.454.CMB.2.raw
  modified_base (404)..(404): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacacttttagctagttatggtgtcagcgtgggtgcgacaggcccctggacaagggcttgagtggagtgggatcggatcagcactttacaataggaaacacaaagtatacgacacataactttcccgaaagggtcaagagtcaatcatcgaccaanagacacatccacgagactaactcgaccctaaacacgtacggaaacgtacggaaacgggtaaaccgtaggaacgtacgtacgtaacgaaccggtaaccgtaccggttactttaattagtttagttggtaacggaacgaaggtaaacttaaacgttaaacctttcccttacttaacttaacttaacgttaacgtaacgtaagtaggttaacgtttcgttaacgttttaag

SEQ ID NO: 435926 - DNA, 725 bp, Homo sapiens
  misc_feature: GZ8MTXP01D64OI.38.25.C03.1.454.CMB.2.raw
  modified_base (375)..(375): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggtcttcgtggttactacttttagctagttagtggtgtcagtcgtgggtgcgacgacggccccgtaggacgaagggcttggaggtggagtgggaatggatcgagctaacttaacaagtaggaaaacaacgaaagtntacgactaataattaacttaccggaaagggacaaggtagtaccaattacgaagtacgaaccaacaacgaaccaacactaccgaacgacgtacccacttacgacccttaacgacgtaacgggtaaaccgtagggaaacgggggtaaacccgttagggaaacgtaacgttaccgaacggaaaccggtaaccgtaaccgggttaccctttaaagttacgtttacggtggtaacggaacggttaaaggtaaacttaaaccgttaaaccgtttcccttaacgtttacttaaacgtttaacggtaacggaaccgttaaggtacgggttaaagtttcggtttaacttttttaaccgg

SEQ ID NO: 435927 - DNA, 688 bp, Homo sapiens
  misc_feature: GZ8MTXP01EK67C.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttagtggtgtcagcgtgggcgcgacgacggcccccgtggacgaagggtcttggaggtggagtgggatggatcagctaactttaacaagtaggaaacaacaaaagtatacgactaagtaattaaactttcccgaaaggggtaccaaggtacgttaccaattacgaacgttacggaaaccaacgaacgacaacacgtaccacgagacacgtacgaccttacgagttacggaactcgggaaacgggtaaccgtagaaacgtacgttacgacggtaccgacgtacggttacctttaagttacttttagttacggtaaggtaacgttaaacggtaagttaaacccgttaaacttttcccgttacctttaacgttaacgtttaacgttaaccgaagtacgtaggttacgtttgttaacgttttttaacg

SEQ ID NO: 435928 - DNA, 673 bp, Homo sapiens
  misc_feature: GZ8MTXP01BIAAM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactacttttagctagttatggtgtcagcgtgggtgcgacgacggccccgtaggacgaagggcttggagtggagtgggatggatcgagactactttaacaaagtaggaaaacaacgaaaagtatacgacaactaattaaacttccgaaagggcaaggagtacaatcaatacgaaccaacacgaacaacactaccaaacgagaccaacgtcgacctaacgaagtacgggaaacgttcggaaacggggtaaacctaggaaacgtacgttacgtacggaaccgtaacgtaacccgggtacctttaaagttatttacgttggtaacggttacggaagtaaacgttaaccgtaaactttccccttaaccgtttacttaacgttaacgttacgtaacgtagtagggttaacgttcgttaacgtttttaacg

SEQ ID NO: 435929 - DNA, 565 bp, Homo sapiens
  misc_feature: GZ8MTXP01D7Y19.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatggatggatcagcactttacaagtggaaacacaaaagtatacgacaactaataaatttcccaaagggtacaaggagtacaattcgaatacgaccaacagaactacatccaacgagaccactgacctacatggaaactgacggggaacctagagatcgtcgacgacacggtcttaagtattagttgtgcgagacgaactaaacttcccttaccttaacacttaattacgaacgtatagggaattgttcttttaag

SEQ ID NO: 435930 - DNA, 720 bp, Homo sapiens
  misc_feature: GZ8MTXP01DQJXD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttcgtggttactacttttagctagttatggtgtcagcgtgggtgcgacgacggcccctaggacgaagggtcttgaggtggagtgggatggaatcgagtctaactttaacgaagtacggaaaacaacgtaaaagtactacgactaactaaattaacgtttacccgaaaggggactaaggacgtacaaatcaactacgaaaccaaacgaacgaaccaacgtaactacccgaaacgaacgaccgtaaaccttcgaccctaacgaaacgtacggaaacgttacggaaacgggggtaaacccgtggaaacgtaacttccgtaacggaaccgtaaccgtaacggttaccttaagtttaactttagttggtaaggaacgttaaggtaaacaaaccgttaaaactttcccttaacctttaacttaaatttaaacgttaaccggtaacggtaaggttaggttaaggttttcgttaacgttttttaacg

SEQ ID NO: 435931 - DNA, 599 bp, Homo sapiens
  misc_feature: GZ8MTXP01CUFLQ.38.25.C03.1.454.CMB.2.raw
  modified_base (411)..(411): a, c, t, g, unknown or other
  modified_base (441)..(441): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggccctggacaagggcttgagtggatgggatggatcgagctacttaacaagtaggaaaacaacaaagtatacgacaactattaaactttccgaaagggtacaagagtacaatcatcgaaccaanacgacacactaccaacgagcactgacctanagtgaaactcggaacggggaaccctggaagactacgtacgacgtacgaaccgggtacctttaagtaattagttggtcgaacgaggtaacttaactaaaactttcccttaaccttacacttaattacgaacgtatagggttaagttcgttctttttaag

SEQ ID NO: 435932 - DNA, 578 bp, Homo sapiens
  misc_feature: GZ8MTXP01ANFLH.38.25.C03.1.454.CMB.2.raw
  modified_base (394)..(394): a, c, t, g, unknown or other
  modified_base (396)..(396): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttggagtggatgggatggatcagcactttacaataggaaacacaaagtatacgcacgaataacttcccaaggacaagagtcatcatgacananacacatccaacgagtaccactcgacctaacactaggtaaactggaagggggaacccttggaacgattcgtacgaaccgaacgtaccggtacctttaatactttagtgtgacgagaacgttactaaacttcccttaccttaacacttaacgtacgaacgtatagggttatcgttcttttaacg

SEQ ID NO: 435933 - DNA, 607 bp, Homo sapiens
  misc_feature: GZ8MTXP01A9LUF.38.25.C03.1.454.CMB.2.raw
  modified_base (359)..(359): a, c, t, g, unknown or other
  modified_base (582)..(582): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagtcgtgggtgcgacacggcccctggacaagggcttgagtggagtgggatggatcgagctacttacaagtaggaaacaacaaagtntacgactacgaattaattccgaagggacaaggagtacattcaagtacgaccaacgagaaccaacactaccgacgaacgacctaacgtcgaccctaactagtacggaaacgttcggaaacgggtaacgtgaaggacttcgacgacgaaccgtacggtccttaaattagttaagtggtaagacgttaggaacttactaaagttcccttacttacattaagtacgngaagttggaactgttaacttttaag

SEQ ID NO: 435934 - DNA, 725 bp, Homo sapiens
  misc_feature: GZ8MTXP01BMOID.38.25.C03.1.454.CMB.2.raw
  modified_base (490)..(490): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctctgcaaggtcttctgttactacttttagctagttatggtgtcaggtcgtgggtgcgacgacggccccgtagggacgaagggtcttggaggtggagtggggatggatcgagtactaacttaacaagtacggaaaacaacgtaaaagtactacgaccaactaattaaacgtttccgaaagggtacaaggatacacgtacaatacgaaacctaacgagaaccaactactacccgaacgaacgacccaacctacgaccctaanaacgtacggaaacttacgggaacgggggtaaacctggaaacgtaacttaccgaacggaaaccggtaaccgtaaccggttacctttaaagttaatttaacgttggtaacggtaacggttaacgggtaacttaaaccgttaaacctttccccgttaaccgtttaacgttaactttaaaccgttaaccgggaaccgttaaggttagggttaaacgtttcggtttaacgtttttaacgg

SEQ ID NO: 435935 - DNA, 670 bp, Homo sapiens
  misc_feature: GZ8MTXP01CK0MM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggcctggggcctcagtgaacgtctctgcaaggcttctggttactacttttagctagttatggtgtcagtcgtgggtgcgacgacggccccgtaggacgaaggcttggagtggagtgggatggatcgagctaactttaacgaataggaaaacaacgaaagtatacgacaataattaaacttccgaaagggacaaggtatacatacatacgaacaacagacacactacccgaagacgaccaacgtcgtaaccctaacgaacgttaacgggaaacgttaggaaacgggggtaaacccgttaggaaaccgtacgttacgacggaaaccgaccgtaaaccggttcctttaaagtttagttaagttggaacgtacggaaaggtaaacttaaaccttaaacgtttcccttaaaccgttattaaacttaacgttaaacgaacgttagtagggttaattcgttctttttaacg

SEQ ID NO: 435936 - DNA, 693 bp, Homo sapiens
  misc_feature: GZ8MTXP01DLGRE.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgaagggcttggagtggatgggatggatcagcactttaacaataggaaacacgaaagtatacgacaactattaacgtttccgaaagggacaaggaagtaccaattaccaatacggaaccaacgaacgaaccaacacgtacccaacggacgaccaacgttacgacccttaacgaaacgttacgggaaacttacgggaaacggggtaaaccccgttgggaaacgtacttaccgtacggaaacccggtaaccgtaaccgggttacctttaagttaactttagttggtaacggaaccggttaaaggtaaacgttaaaccgttaaactttccccttaaccgtttaacttaattaacgttaaccgaacgtaagttaggttaacgttcgttaactttttaacg

SEQ ID NO: 435937 - DNA, 674 bp, Homo sapiens
  misc_feature: GZ8MTXP01BCNQ6.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcatcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacgaggcttgagtggagtgggatggatcagcacttacaagtaggaaacacaaaagtatacgactaacaattaaactttcccgaaagggacaaggagtacatacatacgaaccaacagaacaacactaccaacgacgaccaactcgtaccctaacgagtacggaaactaggaacggggtaaaccctggaacgacttacgtacgaaccgtaaccgtaaccgggttaccctttaagttaacttttacgttggttaacgacggttaaaggtaaacgttaaaccttaaaaccttttccccttaacccgtttaaacttaacgtttaacgttaaaccggtaaccgttaagttacgggttaaagtttcgttaaccgtttttaacg

SEQ ID NO: 435938 - DNA, 698 bp, Homo sapiens
  misc_feature: GZ8MTXP01BLS0J.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacgaggccccctgggacaagggcttgaggtggagtgggatgggatcgagcgtactttaacaagtaggaaaacaacgaaagtatacgacataataactttccgaaagggccaagtacgtacactcatcggaccacgagacacaactccgaacgagacctaacgtcaccgtaacgagtacgggtaaactagggaaacgggtaaaccgttggaaacggtacttaccgtaaggaaccccgtaacgtaaaccgggttacctttaaagtaacgttttacggttaggtaacggttaacggaaaggtaaacgttaaccgttaaaaccgtttccccttaacccgtttaacttaaactttaacggttaaaccgtaaccggttaaggtacgggttaaacggttcggtttaaccttttttaaccggg

SEQ ID NO: 435939 - DNA, 730 bp, Homo sapiens
  misc_feature: GZ8MTXP01AMH16.38.25.C03.1.454.CMB.2.raw
  modified_base (242)..(242): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttntggttactacttttagctagttatggtgtcgagtcgtggggtcgcgacgacggcccccgtggacgaagggcttaggagtggagtgggatggatcgagctaactttaacaaagtaggaaaaccagaaaagtatacgacctaaataacgttaaatttccgaaaagggtccaaggacgtacgaaattccagttacggaacccaacgacgaacaacctaagaccccaacgacggacctacgttaccgacccttaacgaacgtacgggtaaaccgttacgggaaacggggtaaacccgttagggaacgtaacgtcgtaacggtaaccgaacgttaacccgggtacctttaaagttaacgtttaagttgggtaacggtcgaaacgggtaacttaaaccgtaaaccgttttcccttaccccgttaattaaaccggtttaactaaccggtaaccgtaaaggttagggttaaacgttcgtttaacgttttttaaccg

SEQ ID NO: 435940 - DNA, 662 bp, Homo sapiens
  misc_feature: GZ8MTXP01CGZIF.38.25.C03.1.454.CMB.2.raw
  modified_base (338)..(338): a, c, t, g, unknown or other
  modified_base (386)..(386): a, c, t, g, unknown or other
  modified_base (403)..(403): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacaggcccctggacgaagggcttggagtggagtggatggatcagcactttaanaagtaggaaacaacgaaagtatcgacactattaaacttcgaaagggcngagtcatcagtgaccanaacgacacgatacccaaggacacaactcgacctaaccgagtacggaaacgttggaaacggggtaaccctaggtaacgaacgttaccgacgaaaccggaaccgtaacccgggttaccctttaaagttacgttttaaagttccgggttaagaccggttaaagggtaaaccttaaacgtaaaaccgtttcccttaaaccgttacttaacgtaacgtttaacccgaacggttaagtaggttaacgtttaagttctttttaacg

SEQ ID NO: 435941 - DNA, 607 bp, Homo sapiens
  misc_feature: GZ8MTXP01E19S0.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaaggggcttagagtggatgggatggatcagctaactttacaagtacggaaacaacgtaaagtatcgacataagttaacttaccgaagggtacaagagtcatcatcgaccacacgaacactactaccgacgacgactaccgtacgacccgttaacgacgttacggaaaccgtacgaacgggtaacgtagacgtacgtacgaccgtaccgaacgtaccgttactagttatagtcaaggaacagaacttacctactaccttacttaacttacgttaagacggtaagtacgtaggactttcgttaattttccgg

SEQ ID NO: 435942 - DNA, 706 bp, Homo sapiens
  misc_feature: GZ8MTXP01CVTON.38.25.C03.1.454.CMB.2.raw
  modified_base (346)..(346): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggccccgtggacgaagggtcttggagtggagtgggatggatcgagctaacttaanaagtaggaaacaacaaagtatacgacaactattaaacgtttcccgaaaggggacaaggagtacaagttacaagtacgaaacccaacgacgaaccaactactaccgaacgacgacctacgtacgaccctaacgacgttaacgggaaacttacgggaaacggggtaaacccgtaggtaacgtaacgtaccgtacggaaaccgtaccgtaaaccgggttacccttttaaagttacgtttagttggtaacggtaaccggttaaagtaaacgttaaccgttaaaacctttcccttaaccgtttaacttaacgttaacgttaacgtaacgtaagttagggttaacgttcgtttaacgtttttaacg

SEQ ID NO: 435943 - DNA, 656 bp, Homo sapiens
  misc_feature: GZ8MTXP01AIJX7.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacgaagggcttaggaggtggagtggggatggatcgagcaactttaacgaagtaggaaaacacgaaaagtatcgacaactaattaactttcccgaaagggaccaaggtacgtacaatacgaagtcggaaacccaacgaacgaacacaactaccgaacgagaccactacgaccctaacgaagttacggaaactaggaaacggggtaaccgtaggtaacgacttacgacgaaccgtacgtaccggtactttaagttacttagtttggcgtaacgaaggtaacgttaaccttaaacgttcccttaccgttaattacgttaacttacgaacgtagtacggttaagtttcgttaacttttaacg

SEQ ID NO: 435944 - DNA, 735 bp, Homo sapiens
  misc_feature: GZ8MTXP01AJFWN.38.25.C03.1.454.CMB.2.raw
  modified_base (441)..(441): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacgacggccccgtggacgaagggcttaggagtggagtgggatggatcgagctaacgtttaacaaagtaggaaaacaacgtaaaagtagtacgactaactaatttaaacgtttcccgaaaggggcctaaggacgtacactacaagtcggaaacccanaacgaacacaactaccgaacgagacctaacgtcgaccctaacgaacgtacggaaaccgtaggtaaaccggggtaaaccgttaggaaacgtaacgttaccggtaaacggaacccggtaaccgtaacccgggttacctttaaagtttaaccgtttagttacgggtaacgtaacggttaaacggtaaacggttaaaccttaaaccgtttacccttaaacccgtttaaacttaagtttaaccggttaaccggtaacggtaaagttacggggttaaacttggtttaaccttttttaacg

SEQ ID NO: 435945 - DNA, 703 bp, Homo sapiens
  misc_feature: GZ8MTXP01BGU8T.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgacaaggtcttcgtggttactacttttagctagtttatggtgtcgagtcgtagggtcgcgacgacgggtccccgtaggacgaagggtcttggaggtgggagtgggatgggatcgaggactagttaacaagttacggaaaactacgaaagtactacgactaactaagtttaacttacccggaaagggactaaggaagtacaatacatacgaacctacgataaccagtacgaccaacggactaccaccttcggaaccctaatacggtaacgggtaacttagggggaaacctaaccgttaggaaccgttacgtcgtaacccgacgtaaccgaccggttacctttaaagtatttacggttcggaagtaaccggaaggtaaacttaaccgttaaactttacccccttaattttaaaccgaactttaacggtaccgtaagcgtttaggaaaccggttttctttaacgttttaacg

SEQ ID NO: 435946 - DNA, 660 bp, Homo sapiens
  misc_feature: GZ8MTXP01BJVB5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacgacggcccccgtagggaaccgaaaggggtccttaggaggttagggagttggggatgggatcgagctaactttacgaaagtaggaaaacaacaaaaggtactacggacaacgtaagttaaacgtttcccgggggaataaggtcgtactaagtacaagtacgaaccaagacgaacacactacccgacgaacgaccaacttcgaccttaacgacgttaacggaactagggaacggtaaccgtaggaacgtactacgtacgaacgaccgtaccggtacttagtaattagttgtgaacgaagaaacgtaacttaaacgttccctaacttacattaactaaccgagtaagtaggtaagttcgttaactttaacgtttcg

SEQ ID NO: 435947 - DNA, 628 bp, Homo sapiens
  misc_feature: GZ8MTXP01D1V0N.38.25.C03.1.454.CMB.2.raw
  modified_base (255)..(255): a, c, t, g, unknown or other
  modified_base (323)..(323): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccagtagttgtttacacaggtaccaaanaataagaattactcgctaggtacagacaagaaccgagacacgcctacctaagtcgctactatttacgngggactacgttccggtaccgggggtacgttcccggggtcctacggaccgtacttccgaggcggtcgacggtccgggtctggacgactagtactttccactctaccacgtatcgagcacgtcctaggacgaggtctaagaagtagttggtagtacgttaagttttaacgttacgtagttcgagtagtaagtttaatttagtaacgttacgtacccgtgtaacggttcggtttacggggaccggggttacaagggtcgttaggacttaacgtaacgaaaacgtcgttggcggttactcgcgtaaccg

SEQ ID NO: 435948 - DNA, 627 bp, Homo sapiens
  misc_feature: GZ8MTXP01DDVGL.38.25.C03.1.454.CMB.2.raw
  modified_base (289)..(289): a, c, t, g, unknown or other
  modified_base (365)..(365): a, c, t, g, unknown or other
  modified_base (372)..(372): a, c, t, g, unknown or other
  modified_base (417)..(417): a, c, t, g, unknown or other
  modified_base (480)..(480): a, c, t, g, unknown or other
  modified_base (549)..(549): a, c, t, g, unknown or other
tcagtcgatcacgtcacgaccggtgctcgatttagtagtgtagatttgggtttggggacccaaaaaccacacccctccttgggagaatctcctagatcacagctcctcaccatggactggacctggagcattcctttttcttggtggcagcagcaacaggtgcccactcccaggttcaattggtgcagtctggagctgcggtgaagaggccgtggggcctcagtgaacgtctcctgacaggtcttcgtggttactacgttttagctagttagtggtgtcgagcgtgggngcgacgacggcccgtaggacgaggcttggaggttggagtggggatggatcgagctaacttacaagtaggaaaacanaaaagtnagacactaattaattaccgaggcagatacatacatacgacaacanaacacactaccaagaccgacactacgaccttaacgagtagaaccgtaggggaacgtaaaccgngaacgtacgttccgacgaaccgaaccgtaccggtcctttaaagttactttaagttgtagacgggtaaanacgtaaaccttaactttccccttacttaactaattaagtttaaccgaaggtagttacggtaagtttaacgttttaacg

SEQ ID NO: 435949 - DNA, 571 bp, Homo sapiens
  misc_feature: GZ8MTXP01BW235.38.25.C03.1.454.CMB.2.raw
  modified_base (418)..(418): a, c, t, g, unknown or other
  modified_base (435)..(435): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaaataggaaaacacaaaagtatcggacaactaattaaatttcccgaaagggcaagagtcaatcatgacacagacacatcccaagganacaactcgaccctaaanagacggaactagaacggtaactagagactcgagacgacgtacgtacttattattagtgaagagaagaacttaaactaaacttccttacgttacttaattaactaacgaagtagtaggttaattgttaacttttaag

SEQ ID NO: 435950 - DNA, 612 bp, Homo sapiens
  misc_feature: GZ8MTXP01ACL4T.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacacggcccctggacgaagggcttggagtggagtgggatggatcagcactttaacaaagtaggaaacaacaaagtatacgacataattaacttccgaaagggacaagagtacatacatacgaccacagacacactccaacgacgacaactcgaccctaacagtacggaacgtaggaacggggtaacctaggagtacgtaccgtaggaacgacgtaaccggtacctttaagtatttagttggtcggacgagtaacgttaactaaacttccttaccttaacttattaacgttacgaacgtagtaggttaagttcgttaactttttaacg

SEQ ID NO: 435951 - DNA, 700 bp, Homo sapiens
  misc_feature: GZ8MTXP01ELF9J.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagtcgtgggtgcgacgacggtcccctaggacgaagggtcttggagtggagtgggatgggatcgagactaactttaacaagtaggaaacaacgtaaaaggtatacgactaactaagttaactttcccggaaagggacaagtagtacatcaatacgaaccaacagacactacaccagacacactcgacctacgagtacggaaactggaacggggtaactagggtaactacgttacgtaacggaaccggtaaccgtaccgggttacctttaaagttagtttacgttggtaacggaaccggttaaaggtaaacgttaaaccgttaaaacctttccccgttaaccctttaagttaaacctttaacggtttaaacccggaacggttaaaggtaacgggttaaagggttttaacgttaacgtttttttaaccgg

SEQ ID NO: 435952 - DNA, 702 bp, Homo sapiens
  misc_feature: GZ8MTXP01CTKOV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacacggcccctggacaagggcttgagtggatgggatggatcgagcacttacaagtaggaaacacaaagtatacgacactaattaaactttcccgaaaggggtcaaggagtacaatcatacgaacccaacacgaaccacactaccaacgacgaccactcgacctaacagtacggaactagggaacggggaacccttaggaacgtaaacgttcgtaacggaacccggtaacgtaacccgggttaccctttaaagttaacttttacggtttaggtaacggtaccggaaaggtaaacggttaaacccgttaaaaacgttttccccgttaacccgttttaaaccttaattttaaacgttaaacccggtaacggttaaagttacgggggttaaaacgtttcgggtttaaccctttttttaacgg

SEQ ID NO: 435953 - DNA, 626 bp, Homo sapiens
  misc_feature: GZ8MTXP01B3W3J.38.25.C03.1.454.CMB.2.raw
  modified_base (317)..(317): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaattccagccagagtgtttacacacggtaccaaacaataagaattactcgctggtaccagcaagaaaccaggacagcctacctaagtgctctatttacgngggcagtccgtacccggggagtcccgggggtcctagaacgtacttcgaggttcgggcgggtcgggtacgtcgggggaactagtacttttcacgttcctacaaccatccagccgacgccgtggacgggctaggaagtagtggtggttaccggtttattacgtagggttcgaggtcctaaggtttacttacgttcgttacctccttacgtacgttacggtttcgggaccgtaacggggaacttacgcgttaggaacgtacttcggccttaacggaacgtcggttcggcttacggcctaacgttcgtttccg

SEQ ID NO: 435954 - DNA, 556 bp, Homo sapiens
  misc_feature: GZ8MTXP01D76XD.38.25.C03.1.454.CMB.2.raw
  modified_base (335)..(335): a, c, t, g, unknown or other
  modified_base (401)..(401): a, c, t, g, unknown or other
  modified_base (492)..(492): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggagtgggatggatcagcactttaanaatggaaacacaaaagtatacgacaacaattaatttcccgaaagggcaagagtcatcatgaccaanagacacataccacgagcacttcgacctaacatggaaactgaacggggaaactgaagatcgagacgaacacggtacctttatacttagttgngtacgataacgataaacttcccttacgttacattaatacgaagtataggaatgttcttttaacg

SEQ ID NO: 435955 - DNA, 663 bp, Homo sapiens
  misc_feature: GZ8MTXP01AYZYO.38.25.C03.1.454.CMB.2.raw
  modified_base (435)..(435): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctggacgaagggcttgaggtggagtgggatggatcagctacttagaagtaggaaacaacaaagtatacgactaactaattaaacgtttcccgaaaggggtccaaggacgtacatacaagtcgaaccaacacgaacacacnccaacgagacactcgacctacgacgtaaggaactaggaacgggtaacctaggaacgtactacgtacggaaccgtacgtaccggtacctttaagttaacgtttagttcggtaagaacggttaaggtaaaccgttaaacgttaaacctttcccttaacccgtttaagttaacttaacgttaaccggaacgttaggtacgggttaaagtttcggtttaactttttaaccgg

SEQ ID NO: 435956 - DNA, 677 bp, Homo sapiens
  misc_feature: GZ8MTXP01CDQZV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcgagtgaacgtctctgcaaggtcttctggttactacttttagctagttatggtgtcgagtcgtgggtgcgacgacggccccgtggacgaagggtcttaggaggtggagtgggatggatacgaggactaactttaacgaagtaacggaaaacaacgaaaaggtactacggactaaactaattaaacgtttaccggaaagggacaaggtagtaccaattacaacgtacggaaccaactacgaaccaacgactacccgaaggaacgcaacgtcgtaccctaacacgtacggaaacgtgggaaacggggtaccgtaagaacgtacgttacgaacggtaaccgacgtaccggtaccttaattagttagtggtaagacgagaacgttaacttaaacgttcccttaaccgttattactttaacgtaccgaacgtaggtacggttagtttcgttaacgttttaac

SEQ ID NO: 435957 - DNA, 671 bp, Homo sapiens
  misc_feature: GZ8MTXP01CJ4CN.38.25.C03.1.454.CMB.2.raw
  modified_base (284)..(284): a, c, t, g, unknown or other
  modified_base (371)..(371): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgacaaggcttcgtggttactacttttagctagttatggtgtcagcgtggtncgacgacggccctaggacaagggtcttggaggtggagtgggatgggatcgagactaacgttaacgaagtacggaaaacacgaaagtntacgactaaactagttaaacttccggaaagggtcaaggtactcaatacagtacgaaccaacacgaaccaacaacgtaccgaaacgtacgacctaaactcgaaccctaagacgttacggaaaccttaggaaacgggtaacgtaggtaacacttcgaacgaaccgacgtaaccggttaccttaatagtttagttggtaacgaaccgaaggtaaaccaaacgttaaaacttccccttaacgttaccttaagtttaaacgaccgtaacgtagtaggttaaacggttcttaacggttttttaacg

SEQ ID NO: 435958 - DNA, 641 bp, Homo sapiens
  misc_feature: GZ8MTXP01D9A3T.38.25.C03.1.454.CMB.2.raw
  modified_base (286)..(286): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgnggcccctggacgaagggcttgaggtggagtgggatggatcagcacttacaaatggaaaacacgaaaagtatcgacacaataatttccgaaagggcaagagtcatcatcgacacagacacaactccaacgagacactacgacctaacacgtacggaaactggaacggggaaacccgtaggaaacgtactaccgtaacggaaccgacgtaacccggtcctttaaattactttagttggtaagtaacggaaagtaaacggttaaaccgtaaactttaccccttaccgtttaaaccttaacgtttaacgtaacccggtaacgttaagtacgggttaagttcggtttaactttttaaccg

SEQ ID NO: 435959 - DNA, 683 bp, Homo sapiens
  misc_feature: GZ8MTXP01D4MUQ.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctaggacaagggcttgagtggatgggatggatcagcactttacaatggaaacacaaagtactacgcaactaattaactttcccgaaaggggtcaaggtagttaccaattcaactcggaacccaacagaacaacactaccgaacgagaccaacgtcgacccttaaacgacgtacggtaaacgtacggaaacggggtaaccgtaggaacgtacgtaccgtaacgaaccggtaaccgtaaccggttactttaacgttaagtttaggttcggtaacggtaacggttaaacggtaaacgttaaacgttaaaccgtttacccttaaccgtttaacttaaacgttaacgttaaccggtaacgtaagtacgggttaacgtttaacgtttaacgttttaacg

SEQ ID NO: 435960 - DNA, 597 bp, Homo sapiens
  misc_feature: GZ8MTXP01ET9ED.38.25.C03.1.454.CMB.2.raw
  modified_base (559)..(559): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacgacggcccctaggacgaagggtcttaggaggtggagtgggatggatcaggctaactttaacaagtacggaaaacaacgaaaagtatcgactaactaattaactttcccgaaagggcaagtagtacatcatacgaccaacagacacactccaacgagaccactcgacctaacagtacggaaactggaacgggactaggatacgtacgacgacgaacgaccgtacttaattattagtggaagtacgaagacgttaaactaactccttacgttanataagttacgaagtataggttatcgttaacttttaacg

SEQ ID NO: 435961 - DNA, 667 bp, Homo sapiens
  misc_feature: GZ8MTXP01EMW63.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggcccctaggacgaagggtcttaggagtggagtgggatggatcgagctacttaacaagtacggaaaacaacgtaaaagtatacgacaacgtaaatttaacgtttcccgaaaggggaccaaggtaagtaccaatcaagtacgaaaccacaagacaacactaccgaaggacgaccacttcgacctaacgagtacggaaactaggaaacggggtaacctaggaacgtacgttacgaacggaaccgaacgtaaccggttacctttaagttagtttagttggtaacggaacgttaaggaaacttaaacgtaaactttcccttaccttaagaactttaagtaaccgtaaggtagtacgggttaagttcgtttaacttttaaccg

SEQ ID NO: 435962 - DNA, 626 bp, Homo sapiens
  misc_feature: GZ8MTXP01BP0SQ.38.25.C03.1.454.CMB.2.raw
  modified_base (320)..(320): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggcgagagggccacatcaactgacaagtccagccagtagttgtttacacaggtaccaaacaataagaattactcgctggtaccagacaagaaaccaggacacgcctacctaagttcgctctatttacngggtcactccgtacccggggaggttcccgggtccctggaccgtattccgaggccggacaggccgggtctcggagacgtagactttccactctacaccatcagcacgccctagcaggctagaagtagtgtaggtacttagttttacttacgtcgtacgagtcgtaaagttatttaactaggttacgttccttagtaacggttaacggttttaccgggggacccggggttaacgtaaacggtcggttagggttacgttaacgttaaccggaaaacgttaacgtcggtacggcgtaaccggctaacccg

SEQ ID NO: 435963 - DNA, 652 bp, Homo sapiens
  misc_feature: GZ8MTXP01EEH2E.38.25.C03.1.454.CMB.2.raw
  modified_base (610)..(610): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcaggcgtgggtgcgacacggcccctggacgaagggtcttggagtggagtgggatggatcgagactaacttacaagtaggaaaactacgaaaagtactacgactaactaattaaacgtttccgaaagggcaaggactacgatacaagttacgaaaccaacaacgaacaacacaccacgaacgaccaactcgaccctaacgaacgtacgggaaacttcgggaaacggggtaaacccgttggaaacgtacgttacgacggaaaccgacgtaacccgggtactttaagttagtttacgttggtaacgacgttaagaacttaacgtaaactttccttacttanacttaagttacgaacgtagtaggttagtcgttaacttttaag

SEQ ID NO: 435964 - DNA, 635 bp, Homo sapiens
  misc_feature: GZ8MTXP01C9L90.38.25.C03.1.454.CMB.2.raw
  modified_base (363)..(363): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacaggcccctggacaagggcttggagtggagtgggatggatcagcactttaacaagtaggaaacacaaagtatcgacanataaattccgaaagggacaagtagtcaatcatcgaaccacagaacacactaccaacgagcaactcgacctaacacgtacggaaactacggaacgggtaaacccgtagggaactagtacgtacgaaccggaacgtaaccggtccttttaattaacgtttaagttcggtaagaccggaaagtaaacggttaaccgttaaactttcccttaacctttacttaaacttaacgttaaacgaacgtaaggtagggttaagttcgttaacctttttaag

SEQ ID NO: 435965 - DNA, 720 bp, Homo sapiens
  misc_feature: GZ8MTXP01ERYW1.38.25.C03.1.454.CMB.2.raw
  modified_base (289)..(289): a, c, t, g, unknown or other
  modified_base (465)..(465): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagctgggtgcgacnggcccctggacaagggcttgagtggagtgggatggatcgagcacttaacaagtaggaaacacaaagtactagacaataataaactttccgaaagggtcaagagttacattacaatacggaacccaacgagaaccaacaactacccaacggacgtacctacgttacgacccttaaanacgttacgggaaaccgttacgggaaacgggggtaaaccccttaggaaacgtacgttaaccgtcggaaacccggaacgtaacccggggtttacccttaaattaaacgttttaagttcggtaacgggaccggttaaaggtaaaaccggttaacgttaaaacccgtttacccttaaccccgtttaaagttacttaaacgttaaaccggtaacggttaagttaggggttaaaaccgtttggtttaacccttttttaagg

SEQ ID NO: 435966 - DNA, 681 bp, Homo sapiens
  misc_feature: GZ8MTXP01E31RJ.38.25.C03.1.454.CMB.2.raw
  modified_base (282)..(282): a, c, t, g, unknown or other
  modified_base (358)..(358): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagctgggtncgacacggcccctggacgaagggcttggagtggagtgggatcggatcagcactttacaagtaggaaacacaaagtntacgacactaattaacttccgaaagggcaagagtacatcaatcgaaaccacaacgaacaacactccaaccgagacccacttcggaccccttaagaacgttaacggaaacgttacggaacggggtaaacctaggaacgtactaccgtacggaaccgaccgaaaccggttacctttaaatacgtttaagtttgtcggtaaggaaacgtaaacggttaaaccttaaaaacgttttccccttaaccgtttaaaccttaagggtttaaacttacccggaacggtaaagttagggttaagtttaacggttaaccctttttttaaacggg

SEQ ID NO: 435967 - DNA, 612 bp, Homo sapiens
  misc_feature: GZ8MTXP01CDJ0E.38.25.C03.1.454.CMB.2.raw
  modified_base (320)..(320): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagtagtgttttacacaggtaccaaacaataagaattactcgctggtaccagacaacgaaaccaggacagcctactaagtcgctctatttacgngggctactccgtaccgggacggtcccgggtcctcgaccgtacttcgagcggcgacggcgggtctgagactagtacttcactctacacatcagctacgctacgcgacggctaggaagtagtgggtacggtacttaagttttattacgtagtaccgtagacgttaagttaattagttaagtacgttacctcgtaacggttacggttttcgggggacccggggttaacgaaacggtcgttaagggacttaacgttaacgaaaacgtcgtgggtacgttcgtaacgaacctaaccg

SEQ ID NO: 435968 - DNA, 706 bp, Homo sapiens
  misc_feature: GZ8MTXP01AU2OV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggatcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggcccctaggacgaagggcttggaggtggagtgggatggatcgagctacttacaagtaggaaacacaaagtatcgacacaattaacttaccgaagggacaagtagtacatacatacgacacacgaacacacaccgaacgagaccactacgacctaacgacgtacggaaacgtagggaaacggggtaaccgtaggggaactacgttaccgtaacggaacccgaaccggttaaacgggttacccgtttaaagtttaactttaagtttaccgggtaagggaaccggttaaagggaaaccgttaaacgtttaaaaccgtttccctttaacccggtttaaaccttaaagtttaaaccggttaaaccggtaacggttaacggttacgggttaaaaggtttcggtttaacgtttttttaaaccg

SEQ ID NO: 435969 - DNA, 639 bp, Homo sapiens
  misc_feature: GZ8MTXP01DDXQI.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttctggttactacttttagctagttatggtgtcagcgtgggtgcgacacggcccctggacgaagggtcttggagtggagtgggatggatcgagcactttaacaagtaggaaaacaacgaaagtatacgacactaattaaactttacccgaaagggcaagagtaccaagtacaatacgaaccacaacgaaccaactacaccaacggaacacctaactcgaccctaacgaagtacgggtaaactacgggaacggggtaaacccttaggaacgtattacgacgaacgacgaccggtacctttaattagttattggtaagcggaagtaacacgttaaaacttcccttaaccttacttaacttaagttaacgaacgtagtagggttaattgttaacgtttttaag

SEQ ID NO: 435970 - DNA, 654 bp, Homo sapiens
  misc_feature: GZ8MTXP01ARO6K.38.25.C03.1.454.CMB.2.raw
  modified_base (577)..(577): a, c, t, g, unknown or other
  modified_base (612)..(612): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtcgcccactcccaggttcaattggtgcagtctggagctgcggtgaagaggccgtggggcctcgagtgaacgtctcctgcgaaggtcttcgtggttactacttttagctagtttagtgggtgtcgagtcgtgggtgcgacgacggcccgtggacgagggtcttggaggtggagtgggagtggatcgagctaacttaacgaagtacggaaaactaacgaaagtatacgactaactaagttaacgttacgaaagggcaagtagtacatacagtacgaaaccacgaacgaacctaacgactacccgaacgacgacctaccgttacgaccccttaagaacgtacggaaacgttagggaaaccgggtaacgtaggacgtacgttacgacgaccgtacgtaacggttctttaagtactttagtgngaacgttagaacttaacgtaacttcccttacttanaacttaagaccggtaagtagtggttaacttgttcttttaacg

SEQ ID NO: 435971 - DNA, 706 bp, Homo sapiens
  misc_feature: GZ8MTXP01AM003.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactacttttagctagttatggtgtcagcgtgggtgcgacgacggcccctggacgaagggtcttggagtggagtgggatggatcagctacttaacaagtaggaaacaagaaagtatacgacacgtaattaacgttcccgaaaggggtacaaggtacgtcaattacacgtacgaacctacacgaacaacactacccgaacgagaccacgtacgacccttaacgaacgtacgggaaacgttaggaaaccggggtaacccgtaggaaccgtaacgttaccgaacgggaaccgtaaccgtaaccgggttaccctttaaagttaactttaacgttgggtaacgtaaccggaagggtaaacgttaaaccttaaaccgtttccccttaacgtttaacttaacgtttaacgtttaaccggaaccgttaaggtacgggttaaacgtcggtttaacttttttaaccgg

SEQ ID NO: 435972 - DNA, 595 bp, Homo sapiens
  misc_feature: GZ8MTXP01D9PO6.38.25.C03.1.454.CMB.2.raw
  modified_base (387)..(387): a, c, t, g, unknown or other
  modified_base (401)..(401): a, c, t, g, unknown or other
  modified_base (433)..(433): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacacggcccctggacaagggcttgagtggagtgggatggatcagcaactttaacaagtaggaaaacacaaaagtatacgacacagttaagttcccggggacagngtcatcatcgacanagacacataccacgagaccaactgaccctaanatacgggaaacttcggaacggaaccgtgaacgtactacgtacgaccgactaccggtacctttagtaactttagtgtgaacgaagttagaaaccttagttaccctacttaacgattaacgttaacgaacgtaagtagggaatttcttaacgtttaacgtttcg

SEQ ID NO: 435973 - DNA, 694 bp, Homo sapiens
  misc_feature: GZ8MTXP01CQ7N7.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttctggtggcagcagcaacaggtgcccactcccaggttcaattggtgcagtctggagctgcggtgaagaggcctggggcctcagtgaacgtctcctgcaaggctttctggttacacttttagctagttatggtgtcagctgggtgcgacaggcccctggacaaggcttgagtggatgggatggatcagcacttacaatggaaacacaaagtatcgacactataacttcccgaagggcaagagtacatacatacgaccacagacacactacccgaacgacgctaaccgtaggacccctaacgacgttacgggaacttcggaaacgggggaaccccgttaggaacgtacgtaccgtacggaaaccgtacgtacccgggtacccttttaaagttacctttattacgggttcggaccgggttaaagtaacgggaaaccgttaaaaccgtttccccttaacccgtttaaaaccgttaactttaaaccgttttaaacccgggaacccggttaaaagttaccgggggttaaaaaccgttttgggttaaccccgtttttttaaacg

SEQ ID NO: 435974 - DNA, 706 bp, Homo sapiens
  misc_feature: GZ8MTXP01DZD1C.38.25.C03.1.454.CMB.2.raw
  modified_base (643)..(643): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactacttttagctagttatggtgtcagcgtgggtgcgacgacggccccgtaggacgaagggtcttggagtaggagtgggatggaatcgagctaactttaacaaagtaggaaaactaagaaaagttatacgaccaaactaattaaacgtttacccgaaaaggggacaagggtacttacaatacaagtacgaaaccaacaacgaacaacaactaccgaacggaagacctaactcgacctaaacagtaacggaaactggaaacggggtaaacctaggaaacgtacttacgtacggaaacccgtaacgtaaaccggtacctttaaagttaactttaacgttgggtaacgccgaaaggtaaaccgttaaaccttaaaactttccccttaaccgtttaanaaactttaaacgttaacccgaacgttaagttagggttaaatttcggtttaacccgtttttaag

SEQ ID NO: 435975 - DNA, 617 bp, Homo sapiens
  misc_feature: GZ8MTXP01D7HWC.38.25.C03.1.454.CMB.2.raw
  modified_base (372)..(372): a, c, t, g, unknown or other
  modified_base (462)..(462): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacgacggcccctaggacgaagggtcttggaggtggagtgggatggatcgagctactttaacaaagtacggaaaacaacgaaaagtntacgacaactaattaaatttcccgaaagggacaaggagtcatcaatcgaaccaacacgaacacactaccaagacgactactcgacctaanagtacggaactggaacggggaaactggaagtactgtacgacgacgtaccgtcttaatatttagtgtaagacgaagtaacgttaaactaaaccgttccttacgttaacttaagttaacgttaacgaacgtagtaggaatttcgttaacttttaacg

SEQ ID NO: 435976 - DNA, 687 bp, Homo sapiens
  misc_feature: GZ8MTXP01AW8Y7.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttggagtggatggggatggatcagcacttacaatggaaacacaaagtatcgacacaattaactttcccgaaagggcaagacgtacaattccatacgaaccaacgaacgacaacactaccgaacgagaccacgtcgaccctaacacgtacggaaaccttggaaacgggggtaaccctaggaacgtaacgttaccgtacggaaccggaaccgtaaccggggttaccctttaaagttatttaaaccgtttgggttaacgaaccggttaaaggtaaaccgttaaaccgttaaaaaccgttttcccttaaccccgtttaaattaactttaacgttaacccgtaaacgttaacggttagggttaaaagtttcggttaacccttttttaag

SEQ ID NO: 435977 - DNA, 727 bp, Homo sapiens
  misc_feature: GZ8MTXP01D3ANX.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttcgtggttactactttttagctagttatggtgtcagtcgtgggtcgcgacgacggtccccgtggacgaagggtcttgaggtggagtggatggatcagctacttaacaagtaggaaacctaacgaaagtactacgacctaactaacgttaaacgttttccccgaaaagggggtacctaaggggtaaccgttaccgtaaacgttacctaaacgttaccgggaaaccccaaaccgaaacggaaaccctaaacgtaaccgtaccctaaggttaacggaaacggaaccctaaccgtacggtaccctaaaccgtaagttaacggtaaacccgttagggggaaaccggttaaaccgttagaacggtacgtaccgttacgaaccggtaaaccgtaccggttacctttaattacttagtttaacggcgttacggagaaacgtaactaacttccttacttacaattacgtaagacgagttcgtaacgttgtttaac

SEQ ID NO: 435978 - DNA, 671 bp, Homo sapiens
  misc_feature: GZ8MTXP01CHGRQ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgacggcccctggacaagggtcttgagtggagtgggatggatcagcacttaacaagtaggaaaacacaaagtatacgacaactattaaactttcccgaaaggggtacctaaggagtacaattacaatcggaaaccacaacgacaacactacccaacgacgaccaacgtcgaccctaacacgtaggaaacgtacggaaacggggaacccgttagaacggtacttccggacgaaaccgtaaccgtaaccgggttacctttaaagttatttaaacgttgggtaacggaaccggaaaggtaaaccggaacgttaaaaccgtttcccttaacccgtttaaacatttaacgtaaccgtaacgtaagttagggaagttcgttaactttttaacg

SEQ ID NO: 435979 - DNA, 577 bp, Homo sapiens
  misc_feature: GZ8MTXP01BUAUX.38.25.C03.1.454.CMB.2.raw
  modified_base (373)..(373): a, c, t, g, unknown or other
  modified_base (428)..(428): a, c, t, g, unknown or other
  modified_base (431)..(431): a, c, t, g, unknown or other
  modified_base (437)..(437): a, c, t, g, unknown or other
  modified_base (442)..(442): a, c, t, g, unknown or other
  modified_base (444)..(444): a, c, t, g, unknown or other
  modified_base (448)..(448): a, c, t, g, unknown or other
  modified_base (451)..(451): a, c, t, g, unknown or other
  modified_base (457)..(457): a, c, t, g, unknown or other
  modified_base (462)..(462): a, c, t, g, unknown or other
  modified_base (577)..(577): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcgaaggtcttcgtggttactacgttttagctagttatgggtgtcaggtcgtgggtgcggacgacgggtcccccgtagggaaccgtaaaggggtcttggaggttgggagtggggatcgggatcgaggtctaactttaanaagtaggaaaaccagtaaaagtatgacctaatagtaaattccgaaagggcaaggntanatacancacananacanacncaaganacacncacagagagtaacagacggaactgacgactcgagacgacacgtattatattgtgaagacgataacaacgtaactacttacttacttataatagtaacgagtagttagtgttgttn

SEQ ID NO: 435980 - DNA, 592 bp, Homo sapiens
  misc_feature: GZ8MTXP01EHD0U.38.25.C03.1.454.CMB.2.raw
  modified_base (316)..(316): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgttctggatctctggtgcctacggggacatcgtgatgacccagtctccagactccctggctgtgtctctgggcgagagggccaccatcaactgcaagtccagccagagtgtttacacaggtaccaaacaaataagaattactcgcttaggaccagcaagaaaccaggacagcctactaaagtgctacatttacnggcatccgtacccgggagtccgggtcctgaccgattccgaggcggcgaggtccggtactaggaacgactaagtactttcactctacacctatcagcagccctgacaggtctaggaagatgtaggacttaagggttttatacgtgtacagctaagttattaatagtactcctagtacggttaacgtttcggggaccggggaaccttaaaggtcgttagggaattacgttaaccgaaaacggtaacgtggtacggccttacggaaccttaacctaacg

SEQ ID NO: 435981 - DNA, 621 bp, Homo sapiens
  misc_feature: GZ8MTXP01CWY1T.38.25.C03.1.454.CMB.2.raw
  modified_base (553)..(553): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttatggtgtcagcgtgggtgcgacacggcccctaggacaagggcttgagtggagtggatggatcagacactttaacaataggaaaacaacaaaagtactagacaactaagtaaatttacccgaaaggggacaaggaagtcaatacaatcgaaacaacagaacaacactaccaacgacgacaacgtcacctaacagtagaaacctgaacgggggtaacctaggaacgtacttacgcggaaaccgacgtaaccggtaccttaattagttactttggaagtacgaaggtaanaaaccgttaaaacttcccttaaccttaacattaacgtaacgaagtagtaggttagtcgttcttttaag

SEQ ID NO: 435982 - DNA, 718 bp, Homo sapiens
  misc_feature: GZ8MTXP01CFIVS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgaggccccctggacaagggtcttggaggtggagtgggatggatcagcacttacaataggaaacacaaagtatacggacaactaattaaactttcccgaaaaggggtcctaagggacgttacaacttaccgaattacggaaacccaacaacggaaccaaacaactacccgaaagaacgtaccgaaaccttggaacccctaacagttaacgggaaacgttacgggaaacggggggtaaacccttaggaaagacgttaccgtaacggaacccgtaacgtaccgggtaccttttaaataacgttttaattagggtcgtaacggagaaaaccggaaacttaaaaccgttttcccttaaccgtttaacgttaactttaaacttaacccgggtaacgtaacgttacgggttaaggtttaaccggttaacttttttaacgg

SEQ ID NO: 435983 - DNA, 690 bp, Homo sapiens
  misc_feature: GZ8MTXP01B29AN.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgccaaggctttctggttactacttttagctagttatggtgtcagcgtgggtgcgacacggcccccgtaggacgaagggcttagaggtggagtgggatggatcgagcacttaacgaataggaaaacaacaaaagtatagacaacgtaattaaactttcccgaaaggggttaccaaggtaaagttacaacgttacaacgtacggaaacccaaacaacgaaccaacaacttacccgaacgaacgaccaaccgtcgaccctaaccgagttaacggaaacgttacggaacggggaaacccgttggaaacgtacgttaccgtacggaaccgaaccgtaacccgggtacccttaaagttaagtttagttcggtaagaccggaagtaaacggaactaaactttcccttaccgttaccttaataacgtttacgaacgtagtgggttaaattgttaactttttaacg

SEQ ID NO: 435984 - DNA, 586 bp, Homo sapiens
  misc_feature: GZ8MTXP01C0EDG.38.25.C03.1.454.CMB.2.raw
  modified_base (475)..(475): a, c, t, g, unknown or other
  modified_base (512)..(512): a, c, t, g, unknown or other
  modified_base (543)..(543): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagctgggtgcgacacggcccctggacaagggcttgagtggagtgggatggatcagcactttacaatggaaaacacaaagtatacgacaactataaactttcccgaaaggggtacaaggagtcaatcaatcgaaaccacaagacacataccacgagacaactgacctacataggaaactgaacggggaacctggaagactacngaaccgacgaacggtccttaagtattagttgtaacgngaaggtacaactaaacttccttaaccgttanaacttaattaaccgaaggtaatggttaaagttgttcgttttaa

SEQ ID NO: 435985 - DNA, 677 bp, Homo sapiens
  misc_feature: GZ8MTXP01D7MAI.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagtcgtgggtgcgacgacggccccgtaggacgaagggtcttggagtggagtgggatggatcgagctaactttaacaagtaggaaaactaacgaaaagtatacgactaaactaattaaacgtttcccgaaaggggacaaggtacgtactaattaccaagtacgaaaccaaacaacgaacaactactaccgaacggacgacctacgtacgaccctaagagttacgggaaacttggaaacggggtaaacctggaacgtacgttacgacgaccgaacgtaccggttacctttaagttacgtttagtttggaacgtacgaaggtaaacgttaaacctaaacctttcccttaccttaacttaagttaacgttacgaagtaagtgggttaagttcgttaacgtttttaacg

SEQ ID NO: 435986 - DNA, 538 bp, Homo sapiens
  misc_feature: GZ8MTXP01CIG06.38.25.C03.1.454.CMB.2.raw
  modified_base (405)..(405): a, c, t, g, unknown or other
  modified_base (480)..(480): a, c, t, g, unknown or other
  modified_base (486)..(486): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaaggacttgagtggatgggatggatcagcattacaataggaaacacaaagtatacgacaactataatttcccgaaagggcaagagtcaatcatcgaccacagacacanccagagacactcgacctacataggaactaggaacgggaacctgagatctagacgacacggtcttagtattatgtncgaganactaaattccttacttacattaatacgaacgtatagggaatgttcgttttaa

SEQ ID NO: 435987 - DNA, 723 bp, Homo sapiens
  misc_feature: GZ8MTXP01DTWO6.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttctggttactacttttagctagttatggtgtcagtcgtgggtgcgacgacggcccctaggacgaagggtcttggaggtggagtgggatgggatcgagctaactttaacgaagtaggaaacaacgaaagtatacgaccaactaatttaaacgtttacccggaaaggggtaccaaggtaggtaccctaaatacctaacgtacggaacccaacaacgaaccaacgactaccacggaacgactaccgtacgacctaacgaagttacggaaactacgggaaacggggtaaaccttgggaaactacgtaccgtacggaaccgtaccgtaaaccggttaccttttaagttaactttagttcggtaacggtaccgggttaaggtaaaccgttaaacctttaaaacgtttccccttaaaccgtttacttaaacgtttaacgttaaccggaacgttagtacgggttaacgtttcgtttaacgttttttaaccg

SEQ ID NO: 435988 - DNA, 588 bp, Homo sapiens
  misc_feature: GZ8MTXP01EAEW5.38.25.C03.1.454.CMB.2.raw
  modified_base (445)..(445): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgacggcccctaggacaagggtcttggagtggagtgggatggatcgagcacttacaataggaaacacaaagtatcgacacaataactttcccgaaagggcaaggacgttacaattcaatacgaaccaacaagacaacacgtccaacgagacactgaccctanaagtggaactggaacgggtaacctggaagatctagacgacgacgtcttagtacttagtgtaagcgttagacttaactaaacttcccttaacgttcaacttaacttaacgaacgtagtaggttaaggtttcgttaacgtttaag

SEQ ID NO: 435989 - DNA, 672 bp, Homo sapiens
  misc_feature: GZ8MTXP01EOXPH.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagctgggtgcgacacggcccctggacgaagggcttgagtggatgggatggatcagcactttacaagtaggaaaacacaaagtatacgactaacaattaaatttcccgaaaggggtaccaaggtacgtacaactacaatacgaacccaacgacgaaccaacaactaccgaacgagaccacttcgaccctaacgagtaggaactaggaacggggaacctaggaagtaactacgtacggaaccgaaccggtaaccgggtacctttaaagttaagtttacgttgggtaaggtaaccggaaggtaaacgttaaaccgtaaactttaccccttacgttaaccttaacgttaaacgttaaccgtaacggtaagttagggttaaacgtttcgttaacctttttaagg

SEQ ID NO: 435990 - DNA, 644 bp, Homo sapiens
  misc_feature: GZ8MTXP01BQMLU.38.25.C03.1.454.CMB.2.raw
  modified_base (355)..(355): a, c, t, g, unknown or other
  modified_base (467)..(467): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagcgtgggtgcgacacggcccctaggacaagggcttgagtggagtgggatggatcgagcaactttacaaagtaggaaaacanaaaagtatacgacaactaattaaactttacccgaaaggggacaaggtattaccaattaccaatacgaaccaacaagacaacacacccaagacgtaccaactcgaaccctaanagtacggtaaacgtcgggaaacgggaaacttggaaagacttacgacgaaccgacgaaccggttacctttaatatttatggtaagcgttaaaggtaacaaactaaacctttccttaaacctttacaattaacgttaacgaacgttaagtacggttaaaggttcgtttaaccttttaag

SEQ ID NO: 435991 - DNA, 775 bp, Homo sapiens
  misc_feature: GZ8MTXP01BDTC0.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtcgtgggtgcgacacggcccctggacgagggcttgagtggagtgggatgggatcgagctaacttacaataggaaacacaaagtatacgacactaataaactttccgaaagggacaaggtagtacctaagtactaagtacgaacccaaacaagaaccaacaactacccgaacgaacggaccctaaccgttccgaaccctaacgtaacggtacggtaaaccgttacgggaaacgggggtaaacccgttagggaaacgtaacgtttaccgtaacggaaccggtaaaccgtaccggggtttaccctttaaaggtttaaacttttaacgtttgggtaaaccgtaccgggttaaagggtaaacgttaaaaccgtttaaaaccgtttcccccgtttaaaccgtttaaaccgttaaaacttttaaacggtttaaaacccgggtaaacccggttaaacgggtttaagggttaaaaccgggttttggttttaaacccctttttttaacgg

SEQ ID NO: 435992 - DNA, 700 bp, Homo sapiens
  misc_feature: GZ8MTXP01EPVLS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacgcggcccctaggacgaagggcttgaggtggagtgggatggatcgagactactttaacaagtaggaaaacaacgaaagtatcgactaactaattaaacgtttcccgaaaggggacaaggtacgtacacttacgaagttacggaaacccaaacgacgaaaccaaccgaacgtacccaacggacgtaccctacgttaccggaacccttacgaaacgttagggaaacttaggaacgggggtaacccttaggaagtacgtacgtacgaaccgacgtaaccggtacctttaagtaacgtttaacgttgggtaacgacggttaaaggtaaacgttaaaccgttaaacgttttaccccttaccgtttaaacttaatttaacgtacgtaacgtagtaacggagtttaacgttctttttaacg

SEQ ID NO: 435993 - DNA, 622 bp, Homo sapiens
  misc_feature: GZ8MTXP01DK8I0.38.25.C03.1.454.CMB.2.raw
  modified_base (463)..(463): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggtcctggggcctcagtgaacgtctcctgcaaggcttctggttactacttttagctagttatggtgtcagtcgtgggtgcgacgacggccccgtggacgaagggtcttggagtggagtgggatggatcagctacgtttaacaagtaggaaaacacgaaaagtatagacctaactaattaaacgtttacccgaaaggggtacaaggtagtcaattcaatcgaaccacagacacactccaacgagcaactcgaccctaanacgtacggaaactcgggaacgggtaaaccgtgaaacgtacttccgagaaccgacgtaaacggttccttaatattagttgtgacgaagacttaaacgtaaacttcccttacttacaacttaagttaaccgaagtatagggttaattcgttaacttttaag

SEQ ID NO: 435994 - DNA, 664 bp, Homo sapiens
  misc_feature: GZ8MTXP01B42UN.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccagtttcaattggtgcagtctggagctggcggtgaaggaggccgtggggcctcgagtgaacgtctcctgcaaggcttctggttactacttttagctagttatggtgtcagtcgtgggtgcgacgacggccccgtaggacgaagggtcttggaggtgggagtgggatggatcgagctaacttaacaagtacggaaaacaacgaaagtactacgaccaactaattaaacgtttcccgaaaggggtacaagggtacgtaccaattacagtacgaaacccaacgaacgaaccaacctactacccgaacgacgacctacgtacgaccctaacgagtacggaaacctggaaacggggaacctaggaacgactacgtacggaaccgtaccgtaacggtcctttaaagtattagtggtaacggacgaagtaacgttaaactaaactttcccttacgttaacatttaacgtacgtaagtaagtggttaagtgtttaacttttaag

SEQ ID NO: 435995 - DNA, 658 bp, Homo sapiens
  misc_feature: GZ8MTXP01BBQDX.38.25.C03.1.454.CMB.2.raw
  modified_base (421)..(421): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggccccgtggacgaagggcttggaggtggagtgggatggatcgagactaactttaacaaagtaggaaaacaacgaaaagtatacgacaactaagttaaactttacccgaaaggggaccaaggtacccgtanaacttaccaagtacggaacccaacaacgaacaaccactacccgaacgacgacctacgtacgaccctaacacgtacggaaactaggaacggggaacctaggaacgtatccgtacgaacgacgtaccggtaccttaatatttagtggtaacgacggaagaacgttaaacgtaaacttcccttaccgttacttaacttaacgttacgaacgtagtaggttaagttcgttaacttttaacg

SEQ ID NO: 435996 - DNA, 624 bp, Homo sapiens
  misc_feature: GZ8MTXP01BOERL.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacgagggcttggaggtggagtgggatggatcagctacttaacaagtaggaaacaacaaagtatcgacaactaattaactttccgaaagggacaaggtacgtactatactagtacgaacccacagaaccacgtactacccgaacgacgaccactcgacctaacgacgtacggaacgtaggaacggggtaactggaacgtagtacgtacgaccgacgtaccggtctttaattacgttagttgtaagacgagacgaacgttaaactttcccttaccgttacacgttaattaccgtaacgtagtaggttaacgttcgttaacttttaacg

SEQ ID NO: 435997 - DNA, 687 bp, Homo sapiens
  misc_feature: GZ8MTXP01BDU1D.38.25.C03.1.454.CMB.2.raw
  modified_base (288)..(288): a, c, t, g, unknown or other
  modified_base (363)..(363): a, c, t, g, unknown or other
  modified_base (369)..(369): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtcgcccactcccaggttcaattggtgcagtctggagctgcggtgaagacggccgtggggcctcgagtcgaacgtctcctgcaaggtcttctggttactacttttagctagttatggtgtcagcgtgggtncgacgacggccctaggacgaaggtcttggaggtggagtggatggatcgagactacttaacgaagtaggaaacaanaaagtntcgactataattaaacgttccggaaagggtaccaaggtacgtactaacttcgaagtaccggaaacccaacgaacaaaccacaactacccgaaacgacgaccctacgtacggtaccctaacgaagtacgggaaacgtacggaaacgggtaaaccgttggaacgtacgttacgaacggaaccgtaaccggtaaccggtttaccttaagttactttacgttggaacgtacgaaggtaaccttaaacgtaaacctttcccttacttacttaacgttaagtaaccgaagttacgtaggttaacgttcgtttaactttttaacg

SEQ ID NO: 435998 - DNA, 651 bp, Homo sapiens
  misc_feature: GZ8MTXP01A6FV6.38.25.C03.1.454.CMB.2.raw
  modified_base (449)..(449): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacgaagggcttgagtggatgggatggatcagcactttacaagtaggaaacaacaaagtatacgacaactaataaactttcccgaaagggtaccaaggagtacatacaagtacgaaccacgagaccaacactaccacgagaccactcgaccgtaanacgtaggaacctaggaacggggaacccgtaggaacgtagtaccgtaggaacccgaacgtaaccgggtacctttaaagttacgtttaagttacggtaaggtaccgaaaggtaacggttaaaccgttaaaactttcccttaaccgtttacttaacttaacgttaacgaaccgtaagttaggaaacgttgttaaccgtttttaag

SEQ ID NO: 435999 - DNA, 758 bp, Homo sapiens
  misc_feature: GZ8MTXP01A2D01.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcgaaggtcttctggttactacttttagctagttatggtgtcagcgtgggtgcgacgacggccccgtaggacgaagggtcttgaggtggagtggatggatcgagctacgttaacaagtaggaaaacaacgaaaagttacgtacgactaacgtaaagttaaacgtttacccggaaaaggggcctaaggtacgtactaaagttaccaagttacgaaaccaacgaacgaaccaacaaccgtaccgaacgaacgaccgtaacgtacgaccctaaacgaacgtacgggtaaacttcgggaaacggggtaaacccgtaggtaaacgtacgtaccgtaacgaaccggtaaccgtaaccgggtttaccctttaaagttacgtttaacgtttcggttaaacggaaacgttaacgtaaaccgttaaaccgtttacccgttaacccttaaaacgttacgtttaaacgttaaacccgggtacgttaagttaacggggttaagttacggtttaacctttttaacgtttttaaccgg

SEQ ID NO: 436000 - DNA, 754 bp, Homo sapiens
  misc_feature: GZ8MTXP01EAZAY.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagcgtgcggtagaaggaggccgtggggcctcagtgaacgtctctgacaaggtcttcgtgttactacttttagctagttagtggtgtcgagtcgtgggtcgcggacgacggtccccgtaggaacgtaagggtcttaggaggtagggagtggggagttgggaattcgaaggtcctaaacgtttaaacgaagttaaacggaaaaccaaagtaaaaggtataccgaactaaacgtaaatttaaccttaccggaaacgggtactaagggtaagttaccaattaccgaataccgggaaaccaaacgacaaccacaaccaccccgaaggtaccgaccaacgttacgtacccctaaacgagttaacgggaaacgttacggaaacggggtaacctaggtaacgaacgttaccgaacggaaccgtaaccgtaacccggttactttaaattacgtttaacgtttgggtaacgaaccgttaaagggtaaacgttaaaccgtaaacttttcccccttaaagttaaccaatttaacgtaccgaagttagtagggttaattcgttaactttttaacg

SEQ ID NO: 436001 - DNA, 600 bp, Homo sapiens
  misc_feature: GZ8MTXP01D98YV.38.25.C03.1.454.CMB.2.raw
  modified_base (254)..(254): a, c, t, g, unknown or other
  modified_base (325)..(325): a, c, t, g, unknown or other
  modified_base (354)..(354): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagtagtgttttacacaggtacccaaanaataaagaattacttcgctaggtaccagacaagaaaccaggacagccctacctaagttcgctctatttacngggcatcgtacccgggagtcccgggtccngaccgacttcgacggcggcacggcgggtctggagacagtactttcactctacacatcagcacgcctgcgaggtctagaagagtaggtcggtacttagttttagttaaccttgtacaggtactagttaaatttgtaagttacgtccctgtaaaggtcgttttacgggggacccgggggttacaaacgggtcgttagggcgttaactaacgtaaaacggtaaccgtcggtgggacttcgcgtaacccg

SEQ ID NO: 436002 - DNA, 752 bp, Homo sapiens
  misc_feature: GZ8MTXP01AMH61.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctccgtgcaaggtcttctggttactacttttagctagttatggtgtcagtcgtggtgcgacgacggtccccgtaggacgaagggtcttaggagtggacgtgggatggatcgagtactaacgtttaacgaagtacggaaaacctaacgtaaaaggtactacggaacctaacgtaaagtttaaaccgttacccggaaaaggggtacctaaggtaacggtactaaactacccaaacggttaccgaaaccccgaacgaacgaaacctaacctaacgaccccgaaacgacggaaccctaacgtccgaacccgtaaacgacgttaacgggaaacgttacggaaacggggaacccttaggaacgtacgtaccgacgtaaccgaccgtaaccggttactttaagttaacgttagttggtaacgacggttaaggtaaaccgttaaacctttaaacgttccccttacgtttaacttacgttaaaccgttaccgtaacgtaaggttacggaaagtttcgtttaacgttttaacg

SEQ ID NO: 436003 - DNA, 726 bp, Homo sapiens
  misc_feature: GZ8MTXP01EA5KP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaaggaggccgtggggcctcagtgaacgtctctgcaaggtcttcgtggttactacttttagctagttagtggtgtacgaggtcgtgggtcgcgaacgacggtccccgtaggacgaagggtcttaggaggtagggagtggggatgggatcgagtcctaacgtttaagaagtaggaaaactaacgtaaaagtataccgactaactaagttaacgttcccggaaagggcaaggtagtacaattacgatacgaccaacgacgaacaacgtaactaccgaacgaacgaccctaacgtaccggtaccctaaagacgttacggaaaaccgttcgggaaacggggtaaaccgtagtaaaccggtacttaccgtaacggaacccggtaacggtaaccgttactttaaagtacgtttagttggtaacgaacgttaagtaaacgttaaccttaaactttcccttaaccgttaacttaacggtttaacgttaccggaagttaacggtagggttaaacgttccgtttaatttttaacg

SEQ ID NO: 436004 - DNA, 766 bp, Homo sapiens
  misc_feature: GZ8MTXP01CQJBJ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggtcttcgtggttactacgttttagctagttatggtgtcagcgtgggtgcgacgacggccccgtaggacaagggcttggagtggagtgggatggatacgagctaaacgtttacaaagtaggaaaaccagtaaagtatacgactaactaagttaaactttaccgaaagggtaccaagggtacgttacaaacttacgaaacgttacggaaacccgaaacgtaagaacccaacggtaaacctacccggaaaccggtaaccggaaccttaacccggtacggtaaccccttaaagaacgttaacggtaaacgttacgggaaacggggtaacccgttaggaacgtacgttacgaacgaaccgtacgtaaaccgggttaccttaagttaagtttcgttacggtaacggagttaaacggtaacgttaaaccgttaaacgtttccccttaacgtttaaacccgttaaatttaaccggtaaacccgtaacggtttaaaggtacggggttaaactttgtttaaccggttttttaaccg

SEQ ID NO: 436005 - DNA, 780 bp, Homo sapiens
  misc_feature: GZ8MTXP01A68D9.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggccccgtaggaccgaaagggcttgagtggagtgggatggatcgagcaactttaacaaagtaggaaaacacaaaaggtatacggactaaacgtaattaaactttacccgaaagggggtacctaagggtaaacgtacctaaattacccaaagttacggaaaccccaaacgaacggtaaaccaaccaaacggtacccaaaccggaacggacccaacttaccgacccttaaaccaagttacgggaaaaccttacgggaaacgggggaaacccttaggggaaactacgttaccgtacggaaacccgaacgtaacccgggtaccttttaaattacgtttaaacgtttggaacggtaaccggaaagggtaaacgttaaaaccgttaaaaaccgttttccccttaaaccccgtttaaattaaccggtttaaactttaaaccgggaaccgtaaaaggttaccgggggttaaaacttggtttaaccccgttttttaaag

SEQ ID NO: 436006 - DNA, 695 bp, Homo sapiens
  misc_feature: GZ8MTXP01AR2CL.38.25.C03.1.454.CMB.2.raw
  modified_base (364)..(364): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacgacggccccgtggacaagggcttggagtggagtgggatggatcgagctaacttaacgaagtaggaaacacgaaagtntacgactaacgtaagttaaacggtttcccgggggaataaggtaagtacctaaagttacaaagttacggaacccaaacgaacgaacccaactaactacccgaaacggaacgaccaaaccgttcgaaccctaacgaagttacggaaacgttagggaaaccggtaccggtaagaacggtacttacgtaacggtaaccgaaccgtaacggttacctttaagttactttacgttaggcggaacgtaaggacgtaaaccttaaagttacccctacttaacgttaacttacgttaacgacgtaagtacggtagttacgttaactttttaacgtttccg

SEQ ID NO: 436007 - DNA, 653 bp, Homo sapiens
  misc_feature: GZ8MTXP01ASXVG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcaggtcgtgggtgcgacgacggcccctggacgaagggtcttggaggtggagtgggatggatcagcaacttaacaagtaggaaacaacaaagtactacgaccaataacgttaaactttacccgaaaggggtcaaggtacgtacaatacaagtaccgaaccaacaacgaacaactaacaccgaacgacgaccaacttcgacctaacacgtacggaaacgtaggaaacggggtaaacctaggtaagtacgttacgacggaccgtaaccgtacgggttacctttaagttagtttaacttggaagacgttaaggtaacttaacgtaaacttccttaccgttaacattaactacgaacgtataggttaagtcgttaacttttaacg

SEQ ID NO: 436008 - DNA, 645 bp, Homo sapiens
  misc_feature: GZ8MTXP01DQTEO.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcacttaacaagtaggaaacaacaaaagtatagacaaactaataaattttacccgaaaggggtaccaaggtaacgtacctaaattccaatacggaacccaaacaagaaccaacaactaccacggaagaccaacttacgacccttaacaagtacgggaaacctagggaacgggaaaccgttggaaacgatacgtagaccggaactaacggtacctttaatagttaattggtaagcgaagaaacgttaactaaaacttcccttaccgtttacttaattaacgttaaacgaacgtaagtaggggttaattcggttctttttaacg

SEQ ID NO: 436009 - DNA, 738 bp, Homo sapiens
  misc_feature: GZ8MTXP01DJMAH.38.25.C03.1.454.CMB.2.raw
  modified_base (339)..(339): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagttgttttaacacgtaggtaccaaacaataaagtaattacttcgtctaggtaccagacaaacgaaacccaggaacacgtaccctactaagttcgctactaatttacgngggactacgttcccggtaaccccgggggacggttcccccgggggtccctcggaacccgtacttccggacggccggtacgacggtcgggttcctggaagaccgtaagttactttccaacgtctacccaacctactaccgaaaggccaacggtcccgttaggaccgtacgggtactaggaaagtaagttgggttacggtactttaacgttttacgttaaccgtggttaaccgaacggtacgttaaaggtttaatttaagttaacggttaccgttccgtaacgttaacggtttaccggttttacgggggaccccgggggttaactaaacgggtcgttaagggttaacgttaactaacggtaaaaacgtccggttgagggttaccctaaggaacccttaaccg

SEQ ID NO: 436010 - DNA, 655 bp, Homo sapiens
  misc_feature: GZ8MTXP01AEPA0.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggggcctggggcctcgagtgaacgtctcctgcaaggcttctggttactacttttagctagttagtggtgtcaggtcgtgggtgcgacgacggcccctaggacgaagggtcttggaggtggagtggggatggatcagactacttaacgaagtacggaaacaacgaaagtatgacccataattaagttaccgagggaacaagaagtacatcaagtcgaaccaacaacgacaacactacccgaacgacgacacgtcgacctaacaagttacgaaacctaggaacggaaccgtaggaacgtactaccgtacgaaccgaccgtaaccggttacctttaaattacgtttaacgtggtacggtaacggaaagacgtaaacttaaacgttacccttaaccttaacgttacttaacgtaaccggagtaagtacggtaagttcgttaattttaacgttttcg

SEQ ID NO: 436011 - DNA, 789 bp, Homo sapiens
  misc_feature: GZ8MTXP01D3DHO.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacgcggccccgtaggacgaagggtcttggagtggagtgggatggatcgagactaactttaacgaaagtacggaaaacaacgaaagtatacgactaaactaagttaacttcccgaaaggggtacaagggtagtacaaagttcaagttacggaaaccaaacgaacgtaaccaacctaacgtacccgaaacggaacgtaccctaacgttacggaacccttaaacgaacggttaacgggaaaaccgttagggaaaccgggggtaaaacccgttagggtaaacgtaacgttaccgtaacggaacccgtaaaccgttaaacccgggttacccttttaaagttaacgtttacgtttggtaacggtaacggttaaacggtaaacgttaaaacccgtttaaaacgttttccccttaaccgtttaaaccttaaacgtttaaaccggttaaaccggtaaccggttaaacgttaacggggttaacgtttaacggtttaaccgttttttttaaccgg

SEQ ID NO: 436012 - DNA, 548 bp, Homo sapiens
  misc_feature: GZ8MTXP01DK65H.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacacttttagcagttatggtgtcagctgggtgcgacaggcccctggacgaagggcttgagtggatgggatggatcagcacttacaataggaaacacaaagtatacgacacaataaatttcccgaaaggggtcaagagtcaatacatgaccacagacacatccacgagacactgacctacagtggaactggaacggggaacctggaagatcgtacgacgacacggtccttaatattatgtgtacgagagaactaaattcccttacttacataattacgaacgtagtggagtgttcttttaa

SEQ ID NO: 436013 - DNA, 628 bp, Homo sapiens
  misc_feature: GZ8MTXP01DX1QP.38.25.C03.1.454.CMB.2.raw
  modified_base (370)..(370): a, c, t, g, unknown or other
tcagtcgatcacgtcacgaccggtgctcgatttagtagtgtagatttgggtttggggacccaaaaaccacaccccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggtcttctggttactacttttagctaagttatggtgtcagcgtgggtgcgacgacggcccctaggaacgaaggtacgttggaggtggagtgggatggatcgagcaactttaacaagtaggaaaacacgaaagtntacgactaataattaacttccgaaagggactaaggtacgtacaacgtacaagtacgaaaccaacaacgtacaacaactaccgaacgagacccacgtacgtacctaacgagtaacggaaacgtagaacgggggtaaacctgggtaaacattcgacgacgaacgtacggtactttatatttagtgtaagaggagacaactaaactttccttacgttattagttaactacggaatagtaggttaacgtttgttcgtttaag

SEQ ID NO: 436014 - DNA, 611 bp, Homo sapiens
  misc_feature: GZ8MTXP01ADO5A.38.25.C03.1.454.CMB.2.raw
  modified_base (451)..(451): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtcgtgggtgcgacacggcccctggacagggtcttggagtggagtgggatggatcgagctaacttaacaagtaggaaaacaacgtaaagtatacgacaacgtaattaacttcccgaaagggcaaggactcatcatcgaaccacagtacacactaccaggacacactacgaccctaanagtacggaaaccttggaacgggtaactaggactacgtactacggaacgtaacgtacggtaccttaagtacttagtgtcgacgagtaacgaaccttaaattccccttactttaacacgtttaaacgtacgaacgtagtaggaagttcgttaaccttttaag

SEQ ID NO: 436015 - DNA, 667 bp, Homo sapiens
  misc_feature: GZ8MTXP01AN2XZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttacactttttagctagttatggtgtcagtcgtgggtgcgacacggcccctggacgaagggcttgagtggagtgggatggatcagcaactttacaaagtacggaaaacacaaaagtatacgacaactaattaaactttccgaaaggggacaaggacgttacaattacatacgaaccaacgacgaacaacactacccgaacgacgaccacgttacgaccctaaacgacgtacgggaaacttaggaaacggggtaacctaggaacgacttacgacgaaccgaacgtacgggtacctttaaagtatttaacgttggaacgtacggttaaacgacgttaaacgtaaaactttcccttaaccgtttaacttaacttaacgtttaaacgaacgtaggttacggaaagtttcgttaacttttttaacg

SEQ ID NO: 436016 - DNA, 653 bp, Homo sapiens
  misc_feature: GZ8MTXP01B00LE.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcagtgaacgtctctgcaaggtcttctggttactacgttttagctagttagtggtgtcgagtcgtgggtgcgacgacggccccgtaggacgaagggtcgttggaggtggagtgggagtggatacgagtctaactttaacaagtaggaaaacaacgtaaagtatacgactaacgtaattaaacgttccgaagggaccaagtagtacatacagtacgaaccacacgaacaacctactaccgaacgagacctacgtacgacctaacgacgtaacggaaacgttacggaaacggggtaacccgtaggaacgtacgtaccgtacggaaccgtaccgtaccggtacctttaattagttagtggtaagaacgagtaacgttactaaaccttcttaaccttattacttaagtacgaagtagtagttacgttgttcttttaacg

SEQ ID NO: 436017 - DNA, 720 bp, Homo sapiens
  misc_feature: GZ8MTXP01DTECK.38.25.C03.1.454.CMB.2.raw
tcagtcgatcacgtcacgaccggtgctcgatttagtagtgtagatttgggtttggggacccaaaaaccacaccccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggcccctaggacgaagggtcttggagtgggagttgggatcggatcgagtactactttaacaagttaggaaaactaacgaaaagttatacgactaactaagttaaacgtttcccgaaaggggtaccaaggtaacgttacaaacttaccgaagttacgaaacccaacaacgaaccaaccaactacccgaacgaacgtaccaaacttcggaaccccttaacgagttacgggaaacttacggaacgggggtaaaccctggaaacggtacttacggtaacggaaccgtaaccgtaaccggttacccttttaatttaacgtttacgttggtaacgacgggaataaacgttaaacctaaactttcccttaaaccgtttacttaaattaacgttaaacgaacgtaaggtacgggttaatttcgttaacttttttaacg

SEQ ID NO: 436018 - DNA, 564 bp, Homo sapiens
  misc_feature: GZ8MTXP01DP4CS.38.25.C03.1.454.CMB.2.raw
  modified_base (350)..(350): a, c, t, g, unknown or other
  modified_base (471)..(471): a, c, t, g, unknown or other
  modified_base (552)..(552): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataaagaattactcgctggtacaagcaagaaaccaggacagcctacctaaagttgctctaatttactgggcacttcgtacccggggagtcccggggtccngaccgacttcgagcggcaggcgggtctgagacagatttccactctcactacgtcaagcaacgcctagcacgggctagaagatgtaggcgtagttttatacctggttcagtctagttaattnttaaagtcgtcctgtaacgtacggttttcgggacccgggggttacaaaggtcgttagggagttaatcgaaaaagtctaggngctcgctaaccg

SEQ ID NO: 436019 - DNA, 592 bp, Homo sapiens
  misc_feature: GZ8MTXP01EERIA.38.25.C03.1.454.CMB.2.raw
  modified_base (526)..(526): a, c, t, g, unknown or other
tcagtcgatcacgtcacgaccggtgctcgatttagtagtgtagatttgggtttggggacccaaaaaccacacccctccttgggagaatcccctagatcacagcctcctcaccatggactggacctggagcatccttttcttggtggcagcagcaacaggtgccccactcccaggttcaattggtgcagtctggagctgcggtgaagaggccgtggggcctcagtgaacgtctcctgcaaggtcttctgttactacttttagctagttatggtgtcagctgggtgcgacaggcccctaggacaagggcttgagtggatggatggatcagctactttacaataggaaaactacgaaaagtatacgacaactaattaaactttcccgaaaggaacaaggatacattacaatcgaaccaacagaacacataccaagagacactcgacctaacagtacggaaacgtggaacgggtaaacgttggaacgtaactcgtacgaacgacctacggtaccttaatatttaatggtnagagtacgaaactaaacttcccttacgttacacttaattacgaagataggaagttgttcttttaag

SEQ ID NO: 436020 - DNA, 743 bp, Homo sapiens
  misc_feature: GZ8MTXP01EOWBK.38.25.C03.1.454.CMB.2.raw
  modified_base (383)..(383): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtcgcccactcccaggttcaattggtgcagtctggagctgcggtgaagaggccgtggggcctcagtgaacgtctcctgcaaggtcttctggttactacttttagctagttagtgggtgtcgaggtcgtgggtcgacgacgacgggtccccgtaggaacgaagggtcttggaggtggagttgggatggatcagtactaacttaacgaagtaggaaacaacgaaagtntacgacaataattaacgttccgaaagggcaaggtacgtactaactacaacgtacgaaaccaacgaacgaccaacacgtacccaacgaacgtacctaacgttccgacctaagacgttaacgggaaaccttacgggaaaccgggtaaactaggtaacgtacgttccggtaacgaaacccgtaaccgtaaaccgggtttacctttaaagttaacgttttagttcgggtaacggaacggttaaacggtaaaacttaaacccgtttaaactttccccttaaccgtttaacttaaacgtttaacgtaaacggtaaccggttaaagttacgggggttaatttaacggttttaacttttttaacccgg

SEQ ID NO: 436021 - DNA, 609 bp, Homo sapiens
  misc_feature: GZ8MTXP01EB5WJ.38.25.C03.1.454.CMB.2.raw
  modified_base (323)..(323): a, c, t, g, unknown or other
  modified_base (451)..(451): a, c, t, g, unknown or other
  modified_base (483)..(483): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagagttgtttacacaggtaccaaacaataagaattactcgctaggtaccagcaagaaaccaggacacgcctacctaagtcgctctatttacgngggactacgttccgtacccgggggagttccccggggtccctggacccgtattcgaggtcggcagggccgggtctggagactagtactttccactctaccaccatcagcagccctgcaaggctagaagngtagtggacttagtttaactacgtgtacagtntagttaattagtaggttactcgttactaacgggttcgtttacgggggacccggaacgtaggtccgttaggagttaacgttaacccgaaaacggtgttacgggcggttcttcggaacccgttaaccg

SEQ ID NO: 436022 - DNA, 934 bp, Homo sapiens
  misc_feature: GZ8MTXP01BHJY8.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaggcttctggttactacttttagctagttatggtgtcagtcgtgggtgcgacacggccccgtaggacgaagggtcttggaggtgggagtggggatgggatcgacgtactaaccgtttaacaaacgttaacgggaaaaccaaacgtaaaaggtacttacgacctaaactaaagttaaacgtttaccggaaacggggtactaaggggtaacgttaaccgtaaacgttaccctaaacgttacccggaaacccctaaaccggtaaaccgtaaacccgaaacccaaacccgttacccccggaaacgggtaaacccgaaccccgttaaacccttaccggttaaacccccttaaacggtaaaggttaacccggggtaaaaccgttaaccgggggaaacccggggggtaaaccccttaagggtaaccggtaaccgtttacccggtaaaccgggaaaccccggttaaacccggtaaacccggggtttacccttttaaaagtttaaaccgtttacggttttaaaggggaacggtttaaaccccgggaaaaggtaaaccccgttaaaaccgtttaaaaccccgtttttccccgttaaaccgttttaaaacccttaagtttaaaacccggttttaaaccccggaacggtttaaacgggtttaacgggggtttaaaagtttttccgggttttaaacccttttttttaacccgg

SEQ ID NO: 436023 - DNA, 654 bp, Homo sapiens
  misc_feature: GZ8MTXP01AZC7U.38.25.C03.1.454.CMB.2.raw
  modified_base (351)..(351): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacagggcttgagtggatgggatggatcagcacttacaataggaaaacacaaaggtntacgactaacattaactttccgaaagggcaaggacgtccaagtccatcgaaccacagaaccacactcccaacgactacacgttcgaccctaacgatacgggaactagggaaacgggtaaccctggaaggtaactcgtacggaaccgacgtaaccgggtccctttaattaagtttagttcggtggtacgaaaggtaaacgttaaaccgtaaaacgtttcccttacccgtttaaccttaagttaaaccgtttaacggaaccggtaacggttaggggttaaacgtttcggttaacgttttttaacg

SEQ ID NO: 436024 - DNA, 768 bp, Homo sapiens
  misc_feature: GZ8MTXP01E3X4O.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttcgtggttactacttttagctagttagtggtgtcagtcgtgggtgcgacgacggccccgtaggaacgaagggtcttaggaggtggagtgggatggatcgagctaacttaacgaagtaggaaacacgaaagtactacgacaataaattaacgtttaccggaaagggtaccaaggtacgtactaaacgttacaagtacggaaaccaacgaacgaacaactaacacccgaacgaacgacctaacgttacgaccttaacgacgttaacgggaaacctagggaaaccggggtaacctaggtaaacgtacgttaccgtaacggaacccggtaaaccgtaccgggttaacctttaaagttaactttacggtttggtaacggaaccggttaaagggtaaacgttaaaaccgttaaacccgttttccccgttaaaccccgtttaaattaaacgtttaaaccggttaaaccggtaaaccgggtttaacggtaaacgggttaagggttttaaccgtttaacgttttttttaaccccgg

SEQ ID NO: 436025 - DNA, 664 bp, Homo sapiens
  misc_feature: GZ8MTXP01BPE46.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactactttttagctagttatggtgtcagcgtgggtgcgacacggcccctaggaccgaagggcttggagtggagtgggatggatcgagcaactttaacgaagtaggaaacacgaaaagtatacgacaataagttaaacttcccgaaagggcaagagtcatcagtacgaccacaacgacaacactaccgaacgagaccacgtcgaccctaaacagttacgggaaactcgggaaacggggaaacccgttaggaacgtattacccgacggaaccgaaccgtaaccggttaccctttaaagtttacgtttaagttcggtaagaccggaaagtaacgttaaaccgtaaactttccccttaactttacaactttaacgtacgtaaccgtaagtagggttaaaggttcttaacgtttttaacg

SEQ ID NO: 436026 - DNA, 738 bp, Homo sapiens
  misc_feature: GZ8MTXP01ADXWQ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagtcgtgggtgcgacgacggccccgtggaccgaagggtcttggaggtggagtgggatggactcgagctaactttaacgaaagttacggaaaacaacgtaaaagtactacgacctaacgtaaactttaaacgtttacccggaaagggggtacctaagggtaacgttaccgaacgttacccaaagttacgaaacccctaaacgaacggaacccaaaccttaacgtaaccccgaaacggtaacggaccctaacgttacggacccttaaacgaacgttaacgggaaaccgttacgggaaacgggggtaaccttagggaacgtacgtacgtacggaaccgtaaccgtacggtacctttattacgtttagttcgaacggacgaagtaacgttaaccttaaactttcccttaacccgttacttagttaacgttacgaacgtagtaggttacgtttcgttaactttttaacg

SEQ ID NO: 436027 - DNA, 691 bp, Homo sapiens
  misc_feature: GZ8MTXP01BDOT0.38.25.C03.1.454.CMB.2.raw
  modified_base (310)..(310): a, c, t, g, unknown or other
  modified_base (359)..(359): a, c, t, g, unknown or other
  modified_base (421)..(421): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagctgggtgcgacacggcccgtggacgagggcttgnggtggagtgggatggatcagtcacttaacaagtaggaaacaacaaagtntacgactaataattaacgttcccgaaaggggtccaagtacgtcaatccaagtcgaaaccaanacgacactactaccgaagacgtaccaacgttcgacccttaagagttacggaaacgtgggaacggtaaccgttaggaaacctacgttacgacggaacccgtaacggtaccggtttacctttaaattacgttttacgttggaacggtacggttaaacgggtacgttaaacccttaaacgttttccccttaaaccgtttaaccttaacgtttaaacccgttaagggaacgttaacgttaggggttaaatttcgggtttaaccttttttaacgg

SEQ ID NO: 436028 - DNA, 674 bp, Homo sapiens
  misc_feature: GZ8MTXP01EWSXU.38.25.C03.1.454.CMB.2.raw
  modified_base (423)..(423): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacagggcttgagtggatgggatggatcagcgacttacaataggaaacacaaagtatacgacacataattcccgaagggacaagagtcatcatcgacacagacacatccacaggacaaccttgaccctanacgtaggaaacctagggaacggggtaacccttagggaactacgtaccgttaaggaacccggaaccgtaaaccggggtacccttttaagttaaacgtttaacgtttcgggaaggttacccgggaaaggggtaacgttaaacccgtaaaacgtttttaccccttaacccgtttaaccttaaaggtttaaccgtttaaacgtaaaccgggttaagttacgggggttaagtttaacgggtttccgttttttaaag

SEQ ID NO: 436029 - DNA, 621 bp, Homo sapiens
  misc_feature: GZ8MTXP01BW89Z.38.25.C03.1.454.CMB.2.raw
  modified_base (365)..(365): a, c, t, g, unknown or other
  modified_base (440)..(440): a, c, t, g, unknown or other
  modified_base (574)..(574): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcgagtgaacgtctcctgcaaggtcttcgtggttactacttttagctagttatggtgtcagcgtgggtgcgacacggcccgtaggacgaagggcttggagtggagtggatggatcagcacttaacgaagtaggaaacaactaaagtntacgacaataacttaacgttccgaaaggggtacaagtaacgtcaattacaagtacgaaaccacaagaacacaacncgacgagacactgacctacgagtacggaacgtggaacggggtaactgggaacacgtacgtacgaccgacgtaacggtactttaatacttagttcgaagacgaggtaaacttacgtaaactttccttacgttaanacttaacgtaaccgaagtagtaggttacgttcttaacgtttttaacg

SEQ ID NO: 436030 - DNA, 707 bp, Homo sapiens
  misc_feature: GZ8MTXP01D12OQ.38.25.C03.1.454.CMB.2.raw
  modified_base (470)..(470): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactactttttagctagttatggtgtcagcgtgggtgcgacgcggcccctaggacgaaggggtcttggaggtggagtggatggatcagctattaacagtaggaaacacaaagtatcgacaatattaacttaccgaaagggaacctaaggaagtacaacttacgaatcggaacccaacaacgaacaaccactacccgaccgaagacctacttcggaccctaanaacgtacggaaacgtaggtaacgggggaaaccctggtaaacgtacgtcgttaacgacccgtaaacgtaccggggttaacccttttaaggttaaccgttttagtttcgggtaacgtacggttaaaggggtaaacttaaaccgtaaaccttttccccgttaaccgttttaaccttaacgtttaacgttaaccgtaacggttaagtacgggttaacgtttcggttaacttttttaaccgg

SEQ ID NO: 436031 - DNA, 732 bp, Homo sapiens
  misc_feature: GZ8MTXP01DB8R7.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggcttctggttactacttttagctagttatggtgtcagcgtgggtgcgacacggcccccgtagggacgaagggtcttaggaggtggagtgggatggatcgagctaactttaacaagtaggaaaacacgtaaaagtatacggactaacgtaatttaaacgttccgaaagggtacaaggtacgtacaacgttacaagtacgaacccaacaacgaaccaacaaccgtacccgaacggaacgacctaccttacggacccttaaacgaagtacggtaaacgtaggaaaccggggtaacccgttacggaaatacgtaccgtaacggaaccgtaaccggtaccggttaaccttttaagttaaacgtttacgtttggtaacggaacgttaaagggtaacaaaccgtttaaaccgttacccctttacgtttaacttaacgtttaaacgttaacccggtaacgttaaggtagggtttaagtttcgtttaacgttttttaaccg

SEQ ID NO: 436032 - DNA, 661 bp, Homo sapiens
  misc_feature: GZ8MTXP01CT5R3.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgccccactccccaggttcaattggtgcagtctggagctgcggtgaagaggcctggggcctcagtgaacgtctcctgcaaggtcttctggttactacttttagctagttatggtgtcagtcgtgggtgcgacgacggcccctaggacaagggcttggaggtggagtgggatgggatcgagctacgttaacaaagtaggaaaacaactaaagtactacgacctaaactattaaacgttccgaaagggcaaggtatacgaattcgaatcgaaccaacaagtaccaactacacccgaacgacacgtacctacgacctaacgagtacggaacgtacggaggggaaacccttgggaactacgtcgtaacgacgaaccgtaccggttacctttaagtagttagttggaacgtccggaaggtaaacaacgttaaacctttcccttacgtttaaacttacgttaaacgtttaacgaaccgtagtagggttaatcggtttaactttttaacg

SEQ ID NO: 436033 - DNA, 660 bp, Homo sapiens
  misc_feature: GZ8MTXP01EELK5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaaggaggccgtggggcctcagtgaacgtctctgcaaggtcttctggttactacttttagctagttatggtgtcagcgtggtgcgacgacggcccgtaggacgaagggtcttaggaggtggagtgggatgggatcgagctaacttaacgaagtaggaaacaacgaaagtatcgacaactaattaaacttaccgaagggacaaggtagtacaatcaagtacgaaccaaacacgaaccaacaactacccgaacgacgaccactacgaccctaagacgtacgggaaactcggaaacggggtaaacgtaggaacgtactacgtaacggaaccgtacgtaaccggttactttaagtttaagttagttggtaacggacgttaagtaacgttaaacgttaaactttccttaaccgttattaacttaacgtaacggtaagtagtacggttagttcgtttcttttaag

SEQ ID NO: 436034 - DNA, 658 bp, Homo sapiens
  misc_feature: GZ8MTXP01ECDXV.38.25.C03.1.454.CMB.2.raw
  modified_base (533)..(533): a, c, t, g, unknown or other
  modified_base (608)..(608): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaaggaggccgtggggcctcgagtgaacgtctcctgcaaggtcttcgtgttactacttttagctagttatggtgtcagcgtgggtgcgacacggcccctaggacgaagggcttgagtggatgggatggatcgagtcaactttacgaagtacggaaaacaacgaaaagtatacggactaacgtaattaaactttcccgaaaggggacctaagggatttacgaaacttacaagtacggaaacccaaacgaacgaaccaaccactacccgaacggaacgaccaacgtcacccgtaacaagtacggaaactcggaaacgggggaacctagggtaanacgtacgtacgaacgaccgtacggtacttatattagtgtgacgagaacttaaacgtaaacttccttacccgttanactttaagtaaccgaacgtaagtaggttaacgttcgttaacgttttaacg

SEQ ID NO: 436035 - DNA, 663 bp, Homo sapiens
  misc_feature: GZ8MTXP01D3VO0.38.25.C03.1.454.CMB.2.raw
  modified_base (335)..(335): a, c, t, g, unknown or other
  modified_base (365)..(365): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggtcttcgtggttactacttttagctagttatggtgtcagcgtgggtgcgacgacggccccgtggacgaagggcttggaggtggagtgggatggancgagactacttaacaagtaggaaaaccaanaaagtatacgactactaataacttccgaagggactaaggataccatactagacgaacaacacgacaacactaccaacgacacgtactcgacctaacgacgtacggaactaggaaacggtaacgtagaacgtaacgtacgtaggaccgtaacgtaaccggttacttaagttaattaacggttagggtaacgtaacgaacgggtaacttaaaccgttaaactttacccttaaccgtttacttaaacgttaacgtaaacggtaacgtaagtacgggttaaagttccgttaatttttaaccg

SEQ ID NO: 436036 - DNA, 777 bp, Homo sapiens
  misc_feature: GZ8MTXP01ER496.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacaagggcttggagtggagtggatggatcagcactttaacaagtaggaaaacacaaaagtatacgacaactaagttaactttacccgaaaggggcaaggaagttaccaattaccgaatacgaaaccaacgaacgaaccaacaactaccaacgaacgtaccaaccgttacgaccccttaaagaacgttacgggaaaacccgttgggaaaccgggggtaaacccgttagggaaagggtaacttaaccggttaacggtaaacccggaaccgtaaacccgggggttacccttttaaattaaacgttttacggtttagggtaacccgggttaacgggaaaggtaaaccggttaaaccgttaaaaccgttttaccccgttaaaccccgttttaaacgttaaattttaaaccgttttaaacccggggaacgttaaacgggttaacgggggttaaacttttaacgggttttaacgtttttttaaacccg

SEQ ID NO: 436037 - DNA, 775 bp, Homo sapiens
  misc_feature: GZ8MTXP01AVMW6.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggtcttctaggttactacttttagctagttagttggtgtcaggcgtgggtcgcgacgacggccccgtaggaacgaagggtcttggaggtagggaagtggggaatgggtaatacgaaggtacctaaactttaacgaaagttaaggaaaacctaacgaaaaagttactacgaactaaactaaagttttaaacgttccccggaaaaggggacctaagggtacgtttaccccaaagtttaccccgaaattaccggaaaccccaaacgaaacggaaccctaaacaaccgttacccgaaacggttaacaacccggtaaaccttcggtaacccgtaaaccaagttaacggggaaaccttagggaaacggttaaacccggtagtaaaccgacgttacgacggaaaccgtaccggtaaacccgttactttaaaggttatttgtaggtaacgaacgaggtaaaccgttaaactaaaccgtttacccttagttaacttagttaaccgacgtaaaggtgtaagggttactcgtttaacgttttaaccg

SEQ ID NO: 436038 - DNA, 891 bp, Homo sapiens
  misc_feature: GZ8MTXP01DDAXN.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggccaccataccaactgacaacgtccagcctagtagttacgttttaaccacgtaacggtacccaaaacaaattaaagtaatttaccgttacgtcgttacggtaaccagacaaacgaaacccgaggaccaacgtacccctttaaccgttaaaggttcgaccttactacgttttaacgtacgggggtacctaaccgtttacccggaaccccggggggtacggtttcccccgggggttacccctaacgggtaacccccggttaactttacccgggaacgggtccggggtaccgtacgggggtacccggggttaccgtaagggaaacgggtaacctaaagggtttaaacctttacccgaacttacccgtaacctaaaccccgttaacgtaccgaacggtaccgtaccggtaccgtacggaccggtaacggtaacgtaaagggtaaacgtacggttacgggttaacggttaacggttttaacggttttaacgttaaccggtacgtaaccgtacgtaacgtttaagtttaaagtttaacgttaacggttaccgttacccgttaaggtttaaccgggttccggggttaaccgggggaacccgggttaaactacgggtacggttaaacggaacgttaaaaccgtaaaccggtaaaacggtcggttcggtacggttaccgtaaccgaaccgtaacg

SEQ ID NO: 436039 - DNA, 665 bp, Homo sapiens
  misc_feature: GZ8MTXP01B515R.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttcgtggttactactttttagctagttatggtgtcagtcgtgggtgcgacgacggccccgtggacaagggcttggagtggatgggatggatcagcactttacaagtggaaaacacgaaagtcacgacctaactaattaacgtttccgaaaggggccaaggacgtacaatcgaagtcgaaaccacaaggaacctacaactcccgaacgacgacctaacgtcgtaccccgtaagacgttacgggaaaccgttcgggaaacgggggtaaacccttggaacggtactaccgtacggaaccgtacccgtacgggttaccctttaagttacgttaagttggtaacgccggttaaggtaacacgtaaactttcccttacgttacttaacttaacgtaccgtaacgagtaggggttacttggttcttttaacg

SEQ ID NO: 436040 - DNA, 739 bp, Homo sapiens
  misc_feature: GZ8MTXP01AXXUG.38.25.C03.1.454.CMB.2.raw
  modified_base (685)..(685): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcgagtgaacgtctcctgcaaggtcttctggttactacttttagctagttatggtgtcagtcgtgggtgcgacgacggcccgtaggacgaagggcttggaggtggagtggggatggatcgaggtactaacgtttaacaaagttacggaaaacaaacgtaaaaggttactacggaacctaaacgtaagtttaaacgtttcccggaaaaggggtaccaaggtacgtaccaataccgaagtacggaaaccaaacgaacgaaccaaacctacgtaccccgaaacggaacgaccctaaccgttacggaccccttaaacgaacgtaacgggtaaaccttcggggaaaccggggtaaacctaggaacgtacgttacgaccggaaaccgacccgtacggttacctttaagtttagtttagtcggtaagaacgggaagtaaacgttaacgttaaacctttcccttaaccgtttaanactttaacgtaaccggtaacgttaagtacgggttaattcgtttcgtttttaacg

SEQ ID NO: 436041 - DNA, 585 bp, Homo sapiens
  misc_feature: GZ8MTXP01BIH4Y.38.25.C03.1.454.CMB.2.raw
  modified_base (370)..(370): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagctgggtgcgacgacggcccctggacgaagggcttgagtggagtgggatggatcagtacaactttaacaagtaggaaacaacaaaagtatcgacanaataactttaccgaaagggcaagatcatcatcgacacacgacacatccgagacgcactgacctacatggaactaggaacgggaactgagactcgtacgacgaccgacggttaccttaagttattaagttcggtaagcgaagaacgaacgtaaacttccttaccgttattaacttaagtaaccggaacgtagaggttaacgtgttccgttttaacg

SEQ ID NO: 436042 - DNA, 601 bp, Homo sapiens
  misc_feature: GZ8MTXP01C0BUS.38.25.C03.1.454.CMB.2.raw
  modified_base (356)..(356): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggcttctggttacactttttagctagttatggtgtcagcgtgggtgcgacacggcccctggacaagggcttgagtggagtgggatggatcagctacttacgaataggaaacacgaaagtancgacactataaatttcccgaaagggacaagagtcatcagtcaccacacgacacataccacgacgacactgacctacagtacggaaactggaacggggtaacctaggaacgacgttactacgaaccggtacgaaccggtcctttaatacttaagttgtaacgtacgaagggtaacaacgttaaacttcccttaccttacttacttaatttacggaacgttaagtgggttaagtcgttcttttaacg

SEQ ID NO: 436043 - DNA, 667 bp, Homo sapiens
  misc_feature: GZ8MTXP01D89DY.38.25.C03.1.454.CMB.2.raw
  modified_base (450)..(450): a, c, t, g, unknown or other
  modified_base (619)..(619): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagtcgtgggtgcgacgacggccccgtggaccgaagggtcttaggaggtggagtgggagtggatgagtcgaactttaacaataggaaaaccagaaagtatcgactaaactaagttaaacgttcccgaaaggggccaagggtatacatccaagtacggaaccaaacacgacaacgacncccaaggaactcacgttagcccctaacgtagtacggaaactacgggaacgggtaaaccgttaggaacggtaacttccgtacgaaccgtaacggaaccggttacctttaattaagttagttggtaacgacgaaaggtaacgttaaaactaactttcccttaaccgtttanaacgtttaattaccgaagtaagttcgggaattcgttaactttttaacg

SEQ ID NO: 436044 - DNA, 714 bp, Homo sapiens
  misc_feature: GZ8MTXP01BQMVA.38.25.C03.1.454.CMB.2.raw
  modified_base (377)..(377): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttctggttactacttttagctagttatggtgtcaggtcgtgggtcgcgacgacggtccccgtaggacgaagggtcttaggaggtggagtgggatggatcgagactacttaacgaagtaggaaacaacgaaaagtntacgacaataataacttaccgaaagggacaagagtacatacagtacgacaacagacaacactaccaacgacgaccacgtacgaccctaagacgtaacggaaacgttcgggaaacggggtaaaccgttaggaacgtacgtaccgtacggaaccgtaacgtaccggttaacctttaagttaacgtttaagttcgggtaacggtacggttaaacggtaaacgttaaaccgttaaaacttttcccccgttaaacgtttaaaccttaaacgttttaaccgttaaaccggtaaaggttaacggttacggggttaaacgtttcgggtttaactttttttaacgg

SEQ ID NO: 436045 - DNA, 767 bp, Homo sapiens
  misc_feature: GZ8MTXP01ELYXR.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggtcttcttggttactacttttagctagttatggtgtcagtcgtgggtgcgacgacggcccctaggacgaagggtctgagtggagtgggatggatcgacgtacgtaaccttaacgaaagttaggaaaacctaaacgaaaagtactacgacaaacgtaattaaacgtttcccggaaagggtaccaaggacgtaccgtaaactcgtaactacgggaaacccaacgtaacgaaacctaaccaaacgtacccgaaacggaacgtaccctaaaccgttacgtaaccccgtaacgaaacgtttacgggaaaacgttagggaaacggggttaaacccggtaggtaaacggtacgttaccgtaacggaacccgtaacggtacccggttaacctttaagttaagtttacgttgggtaaggtaccgttaaaggtaaacgttaacccgtaaactttccccgttaaccgtttacaaacgttttaaccgtaaacgaaccggttaggtaagggttaaacggttcttttaacggtttttaacg

SEQ ID NO: 436046 - DNA, 754 bp, Homo sapiens
  misc_feature: GZ8MTXP01BV903.38.25.C03.1.454.CMB.2.raw
  modified_base (374)..(374): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagtcgtgggtgcgacaggcccctaggacgaagggcttggagtggagtgggagtggatcgagtcctaacgttaacaagtacggaaaacaacgtaaaacgttntaccgactaactaagttaacgttaccgaaaggggtctaacgggtacgtacgaacttaccaagttaccggaaaccaaacgtaacgaaccctaaacgaaccgtacccgaaaccggaacggtaccctaaccgttaccgtaccccgttaaacgaacgttaacgggtaaacgtacgggtaaaccgggggtaaacccgtaaggtaacggtacttaccggtacgaaccggtaaccgtaccggtttaccttaaagtttacgtttaacgtggtaacggtaacggaacgtaaacgttaaccgttaaaacgtttcccttaaccttacgttaacgtttaacggtaaccggtaagtacggttaaggggttactttcgtttaacgtttttaacg

SEQ ID NO: 436047 - DNA, 569 bp, Homo sapiens
  misc_feature: GZ8MTXP01ATH1V.38.25.C03.1.454.CMB.2.raw
  modified_base (354)..(354): a, c, t, g, unknown or other
  modified_base (413)..(413): a, c, t, g, unknown or other
  modified_base (429)..(429): a, c, t, g, unknown or other
  modified_base (532)..(532): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgaggcccctggacagggcttgagtggagtgggatggatcgagcacttacaagtacggaaacacaaagtntcgacaacattaaacttccgaagggtcaagagtcatcatcgacacagacacatccaganacactacgaccctaanacgtacggaactaggaacgggtaacgtagaacgtacgtacgacgaacgacgtacgtacttaattagttagtgaagacgagacgaactaacgttccttacttanataacgtacgaagtagtagttacgttcgttcgtttaa

SEQ ID NO: 436048 - DNA, 650 bp, Homo sapiens
  misc_feature: GZ8MTXP01CVF54.38.25.C03.1.454.CMB.2.raw
  modified_base (206)..(206): a, c, t, g, unknown or other
  modified_base (372)..(372): a, c, t, g, unknown or other
  modified_base (415)..(415): a, c, t, g, unknown or other
  modified_base (455)..(455): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagnggcgtgggcctcagtgacgtctctgcaaggtcttcgtggttactacttttagctagttatggtgtcagtcgtgggtcgcgactacggccccgtaggacgaagggtcttggagtggagtgggatgggatcgaagctaactttacaagtaggaaaacaagaaagttanacgactaactaattaaacgtttccgaaagggacaaggtactanaactcaagtcgaaacaactacaacaacaacaccgaacganactacgtacgaccctagaagtacggaacgtacggaagggtaaccctagaagtacttacgacgaccgtacaccggttacttagtacttagtagtcgagttaaacgaacttaaacgttaaaccttccttaacgttaacttaactttaacgtaaccggtaactaggttacggttaaagtttcgttaaccgtttttaag

SEQ ID NO: 436049 - DNA, 660 bp, Homo sapiens
  misc_feature: GZ8MTXP01A3L5R.38.25.C03.1.454.CMB.2.raw
  modified_base (206)..(206): a, c, t, g, unknown or other
  modified_base (244)..(244): a, c, t, g, unknown or other
  modified_base (358)..(358): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagnggccgtggggcctcgagtgacgtctctgcgaggtcttntgttactacttttagctagttatggtgtcgaggtcgtgggtcgcgacgacggtccccgtaggaacgaagggtcgttggaggtggagtgggatgggatcgagtactacgtttaanaagtaggaaaacacgtaaagtatacgacaactaagttaacgttccgaagggacaaggactcatacagtacaacacacgacacactccaaggacacacgtcgaccagtagtaaggaacgtaggaacggtaactaggaacacgttcgtaaacgaccgtaacgtaccggttactttaagtacgtttaacgttggaacggtaaccgttaaagtaaacgttaaaccgtaaactttcccttaaacgtttcaaacgtttaacgttacgaacggttaaggtagtttacggttccgtttaagttttaaccg

SEQ ID NO: 436050 - DNA, 688 bp, Homo sapiens
  misc_feature: GZ8MTXP01B4NVL.38.25.C03.1.454.CMB.2.raw
  modified_base (334)..(334): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgttctggatctctggtgccgtacggggacatcgtgatgacccagtctccagacctcctggctgtgtctcgtgggcgaggacggccacatcaactgacaagtccagccagtagttgtttaacacgtagtaccaaactaaataaagtaattacctcgacttcggaaccagacaacgaaacaggacacgtcctactaagtcactctaatttacgnggactacgtccgtacccggggtcggtaccccggtcctacgaccgtctaccgcggcggcgacggccggtacaggaacgacgtagtactttcactctacactactcaggcacgtccaggacgtacgcgtagaagtacgtgggtaacgtacgtttaagggtttaacgtttacgttacggtacctacggtaacttaaggtttaaatttacggttaacgtaccgttaccccgttagttaaggggtttaacccggttttaccgggggaacccgggggttaaacgaagggttaccgtaacggggttaagaacttaccggaaaacgtacgttcggtacgtacgaccgttccgaaaccgtttg

SEQ ID NO: 436051 - DNA, 792 bp, Homo sapiens
  misc_feature: GZ8MTXP01A2W4Q.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactacttttagctagttatggtgtcgagtcgtgggtgcgacgacggccccgtggacgaagggtcttggaggtggagtgggatgggatcgagctaactttaacgaaagtaaggaaaaaactaaaggtatacgaacctaacgtaaagttaacggtttacccgggggactaaagggtaacggtaacaagttaccgaaagttaccggaaacccaacgaacgaacccaacgacctacccggaaacgacgaccctaacgttccggaacccttaacaacggttacgggaaaaccgttacgggaaacgggtaaaccccttagggggaaacgtacgttacccgtacggaaacccggaaccgttaacccgggttaacttttaaagttagtttaacggttcgggtaacggaacgggtaaacgtaacggttaaaccttaaaccttttccccgttaaaccttaaaccgttaaattttaaaccggttaaccggtaaacgtaggttaacgggtaaagttcggtttaaccctttttaagttttaaccgtttaacccggg

SEQ ID NO: 436052 - DNA, 563 bp, Homo sapiens
  misc_feature: GZ8MTXP01AB2E6.38.25.C03.1.454.CMB.2.raw
  modified_base (323)..(323): a, c, t, g, unknown or other
  modified_base (417)..(417): a, c, t, g, unknown or other
  modified_base (494)..(494): a, c, t, g, unknown or other
  modified_base (563)..(563): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggaccaagggcttgagtggatggatggatnagcactttacaataggaaacacaaagtatgacacgaattaaacttccgaaaagggtcaagagtccaatccatcgaacacagacacagtacccanagccaatcgacacatagaactgaacgggggacctggacaactccgagaccgaacgacggtaccttaatagtattggngacgagaacttaactaaacttccttacttacattaagtacgaacgtagtaggttattcgttaacgtttn

SEQ ID NO: 436053 - DNA, 698 bp, Homo sapiens
  misc_feature: GZ8MTXP01CF570.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctggcggtgaaggaggccgtggggcctcgagtgaacgtctccgtgacaaggtcttcgtggttactactttttagctagttatggtgtcagcgtggtgcgacgcggcccgtaggacgaaggtcttggagtggagtgggatggatcgagactaacttaacgaaagtacggaaaaccaagaaaagttactacgactaaataaacgtttaaacgtttaccggaaaaggggtacaaggtaacgttacaacgttcaacgtacgaaaccaacaacgaaccaacacacccgaaacgacgacctacgtacgacccttaaagacgtaacgaacgtacggaaacggtaacgtagaagtacgtacgtacggaaccgtacgaacccggtttacttaagttagttaacgttgaacggtacgttaaagtaacgttaaaccgtttaaactttccccttaacgttaacaacgtttaagtaaacgtaacgtagttacgggttattccgtttaactttttaag

SEQ ID NO: 436054 - DNA, 616 bp, Homo sapiens
  misc_feature: GZ8MTXP01ADB3G.38.25.C03.1.454.CMB.2.raw
  modified_base (290)..(290): a, c, t, g, unknown or other
  modified_base (342)..(342): a, c, t, g, unknown or other
  modified_base (360)..(360): a, c, t, g, unknown or other
  modified_base (390)..(390): a, c, t, g, unknown or other
  modified_base (412)..(412): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcgaaggtcttctggttactacttttagctagttatggtgtagcgtgggtgcgacncggccccgtggacgagggtctggagtggagtggggatggatcgagctactanaagtagaaacacaagtancgacatatacgttcgagggacaggtaactnatacatcgaacacacgaccacnctaccgacgacgaccacgtcgacccttaacgagtacgggtaacgtaggaaaccgggtaacgtggaacgtcttacgacgtaccgaccgtacggtaccttaattacttagttcggtagcgaagttacgtaaacttaaccgttccttaacttaacgatttagtaaccgtagtaagtggtaagttcgtttaactttcgttttaaccgg

SEQ ID NO: 436055 - DNA, 631 bp, Homo sapiens
  misc_feature: GZ8MTXP01BB0O5.38.25.C03.1.454.CMB.2.raw
  modified_base (445)..(445): a, c, t, g, unknown or other
  modified_base (621)..(621): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagcgtggggtgcgacgacggccccgtaggaccgtaagggcttggaggtggagtgggatggatcgagctaactttaacaagtacggaaaacacgtaaaagtatacggacaactaacttaaacgttcccgaaaggggcctaagtaacgttcaaatcgaactcggaaacccanaacgacaacgactaccaacgagaccacgttcgacctaacagtacggaactacggaaggggtaaccctagacgtactccgcgaaccgtacgtacgtacctttatagtttgtggtaagacgaagacttaactaaacttccttaccttagacttaactacgaatagtaggttaagtttnttcgtttaag

SEQ ID NO: 436056 - DNA, 684 bp, Homo sapiens
  misc_feature: GZ8MTXP01DMO25.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttctggttactacttttagctagttatggtgtcagcgtgggtgcgacaggcccctggacgaagggcttgaggtggagtgggatgggatcgagctactttaacaaagtaggaaaacaacaaagtactacgacaaactaattaaacgtttcccgaaagggggaccaagggtaacgtactaattaccaagtacggaaacccaaacgaacgaaccacgaactaccgaacgagaccactacgacctaacgagtaggaaacgttaggaaacggggtaaaccctggaacgtaacgtccgtacggaaccgacgtaaccggtacctttaagttattaagttggtaacgaacgttaaggaaacgttaaacgttaaactttcccttacctttaacgttaacgtttaacgttaaacgtaacgttaagtaggttaaggttcgttaacgttttttaacg

SEQ ID NO: 436057 - DNA, 817 bp, Homo sapiens
  misc_feature: GZ8MTXP01EKQXE.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaggtcttctggttactacttttagctagttatggtgtcagtcgtggggtgcgacgacggccccgtaggaacgaaggtacgttggaggtggagtgggagtgggatacgagtactaacttaacgaagtaaggaaaaccaacgtaaaaggtataaccggacctaaacgtaagtttaaacgtttcccggaaaagggtactaagggtaacgttacctaaatacctaagtacggaaaccctaacgaacgaaccaacctaactacccgaacggacgaccctaaccgttacgaccctaacgtaagtacggtaaacgtaacgggtaaacggggtaaaccgtaagggaaccgtacgtaccggtaaacggaaccgaaacccgttaaacccgggttaccttttaaacggttaacttttaaggtttcgggtaacgggttaaacggaaacggttaaacccgttaaaaccgtttaaaacccgttttacccccgttaaacccgtttaaacttaaacgtttaaccgttaaaaccggtaaccggtttaaggttaagggggttaaacgttttaaccggttttaacttttttttaacccgg

SEQ ID NO: 436058 - DNA, 744 bp, Homo sapiens
  misc_feature: GZ8MTXP01DSK02.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagtcgtgggtgcgacacggccccgtaggacgaagggtcttggagtggagtgggatcgggatcgagcgtaactttacaaagtggaaaactaacgaaagtatacggactaacaattaaacgtttacccgaaagggactaacggtagtaccctagttaccaatacggaaccacaacgacaactacgtaccaaacggagtaccaactcggtacccctaaagaacgttacgggaaacgtacgggtaacgggggtaaacccttagggaactacgttaccgtacggaaacccgtacgtaaaccgggttacctttaaggttaactttacgttgggttaagacccggttaaagtaacggttaaacccgttaaaaactttccccttaaacccgttttaacaaaccgtttaaacgtttaaaccccgggtaaacggttaacggttaggggttaaaacgttttcgggtttaacccttttttaacgg

SEQ ID NO: 436059 - DNA, 697 bp, Homo sapiens
  misc_feature: GZ8MTXP01EH4MI.38.25.C03.1.454.CMB.2.raw
  modified_base (381)..(381): a, c, t, g, unknown or other
  modified_base (461)..(461): a, c, t, g, unknown or other
  modified_base (485)..(485): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcgtggggcctcagtgaacgtctcctgcaggtcttctggttactacttttagcagttatggtgtcagtcgtgggtgacgacgacggccccgtaggacgaagggcttaggaggtggagtggggatgggattacgaggtactaacgtttaacaaagtaggaaaaccaagtaaaagtntacggacaaacgtaattaacgtttacgaaacggggactaaggacttacaaacttcgaactacggaccaaacagacaacanaccaaggacacaacgtcacctaanacgtagggaaacttggaaacgggggaaccttaggaacggtacttcgaagaaccgacgtaaccggttaccttaaatttacgtttaacgttggaacggttaacgagggtaaaccttaacgttaaaaactttcccttaaacgtttaaccaaagtttaaaccggtaccgtaaacgttaggtaacggggttaaactttggtttaacccgtttttaag

SEQ ID NO: 436060 - DNA, 691 bp, Homo sapiens
  misc_feature: GZ8MTXP01BLGM8.38.25.C03.1.454.CMB.2.raw
  modified_base (373)..(373): a, c, t, g, unknown or other
  modified_base (480)..(480): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttctggttactacttttagctagttatggtgtcagtcgtggggtgcgacgacggtccccctagggaaccaaaggggtcttaggaggtgggaagtggggaattgggattaccgaggtacctaacctttaanaaagtaggaaaactaacgaaaaggttatacggacaaacgtaagttaaactttacccgaaaggggacctaaggtacgtactaacgtacaacttacggaacccctaaanacgtaacaactactaccacgagaccacgtcactacagacggaactagaacgggaaccttggaaactacgtacgtagaaccgtacgtaaccggtcttaagttagttaacgtggtaacgtaggacgtaaagttaaccgtaaagtttcccttaacccttacttaagttaactacccggtaagtagtaggttaaggttcgtttaaccgtttaacg

SEQ ID NO: 436061 - DNA, 673 bp, Homo sapiens
  misc_feature: GZ8MTXP01A5QNS.38.25.C03.1.454.CMB.2.raw
  modified_base (486)..(486): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcgagcgtgggtgcgacgacggcccctggaccgaagggtcttggaggtggagtgggatggatcagctacttaacaagtaggaaaacacaaaagtctacggacaaactaattaaacgtttcccgaaaaggggccaagggtacttacaattacaagtacggaaacccaacaacgaaccaactaactacccgaacgaacgaccactacggacccctaanaacgtacggaaacgtacggaaacggggtaaccctaggaacgaacgtacgtacgaccgaaccgtaacggtacctttaaagttacgttaacgttggtaacgacgaaaggtaacttaaacgttaaacttccttaaccgttaacttattaacttaacgaacgtagtaggttaagttcgttaactttttaag

SEQ ID NO: 436062 - DNA, 711 bp, Homo sapiens
  misc_feature: GZ8MTXP01CM13Q.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgaggccccctggacgaaagggcgttgagtggatgggatggatcagctacttacaagtaggaaacacgaaaagtatacgacaactaattaaacttttcccgaaaggggtcctaaggacgttacaattacaagtcgaaacacgaacgacaaccatacccaacgacgacaacttcgaccctaatacgtacggaacgttacggaacggggtaaaccccgttggaaacgtacgtacgttacggaaccgtaaaccgtaacccgggtacctttaaaggttaacttttaacgtttggaaccgtaaggttaacggaaacggaaaccgtttaaaacgtttcccctttaacccgtttaaattaacgtttaaacgttaacccggtaacggttaggttaaccggttaaggggtttaactttaacggtttttttaaaccg

SEQ ID NO: 436063 - DNA, 658 bp, Homo sapiens
  misc_feature: GZ8MTXP01CJGQV.38.25.C03.1.454.CMB.2.raw
  modified_base (294)..(294): a, c, t, g, unknown or other
  modified_base (482)..(482): a, c, t, g, unknown or other
  modified_base (649)..(649): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctggcggtaggaaggaggccgtggggcctcgagtgaacgtctcctgacaaggtctttcgtggttactacttttagctagttatggtgtcagcgtgggtcncgtacgacggccccgtaggaacgagggtcttaggaggtggagtggggatgggtatcgagtactaacgtttaacgaagtacggaaaacaagtaaagtatacgacataattaacgttccgaaagggcaaggtagtaccagtacaacgtacgaacccaacgacgaaccaaccacgtaccaaggacactacncgtacctaacagtacggacgtacggaacggtacgtagagtactgtaccgaacgacgtaccggttactttaagtatttagttggaacgtaacggagtaaacgttaaaccttaaacgttcccttaacgtttacagttaacgttacgaagtaaggtcgttaagttcgttntttttaacg

SEQ ID NO: 436064 - DNA, 746 bp, Homo sapiens
  misc_feature: GZ8MTXP01DNZSY.38.25.C03.1.454.CMB.2.raw
  modified_base (219)..(219): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctnagtgaacgtctcctgcaaggtcttctggttactactttttagctagttatggtgtcagcgtgggtgcgacgacggcccctaggacgaaagggcttggagtggagtgggatgggatcagtctactttaacaagtaggaaacaacgaaagtatacgactaactaagtaaactttcccgaaagggtacaaggtaagtacaagtcaagtacgacaacaagaacaacgtacaccgaagacgacactcgtacctaacagtacggaacgtaggaacggggtaaaccttggaagtacgtttacgtacggaaccggaaccgttaaacggtacccttttaaagtttaacttttaacgtttgggttaaccggtaaggaaacgggttaaaacgttaaacccgtttaaaaacgttttcccccttaacccgtttttaaaaccgttaaattttaaaccggttaaaaccccgggttaacggttaaaacgggtttacggggttaaaaagggtttttccgtttaacgtttttttttaaaccccgg

SEQ ID NO: 436065 - DNA, 620 bp, Homo sapiens
  misc_feature: GZ8MTXP01D1PO7.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtgtcagcagcaacaggtgcccactcccaggttcaattggtgcagtctggagctgcggtgaaggaggccgtggggcctcgagtgaacgtctcctgcaaggtcttctggttactacttttagctagttatggtgtcagcgtgggtgcgacgcggccccgtaggacgaagggcttggaggtggagtggatggatcagctaacttaacaagtaggaaacaagtaaagtatcgactacattaacttcgaaagggcaaggatacatacgatacggaacaacagtaacactactaccgaacgacgaccacgtacgaccttaacgacgttacggaaacgtaggaacgggggtaacctggaacgtactcgacgaacgtacgtacgttacttatacgttagtggcgtacgaggtaacttaacgtaaacttcccttaacttacttagttaacgtaacgaagtagtaggttaacgtctttcgttttaacg

SEQ ID NO: 436066 - DNA, 569 bp, Homo sapiens
  misc_feature: GZ8MTXP01BLFEN.38.25.C03.1.454.CMB.2.raw
  modified_base (399)..(399): a, c, t, g, unknown or other
  modified_base (467)..(467): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggatgggatggatcagcacttaacaagtggaaaacacaaagtactcgacacaattaacttcccgaaagggcaagagtcatcatcgaccanagacacatacccgaagacgcaactcgacctaacagtcggaactgaacgggggaacctgaacgtactcngaccgacgaccggtcctttaatatttaacgtgtcgacgttacgaagaactaaacttcccttaaccttacattaataccgaagatcgggaatgttcttttaag

SEQ ID NO: 436067 - DNA, 721 bp, Homo sapiens
  misc_feature: GZ8MTXP01A2V3F.38.25.C03.1.454.CMB.2.raw
  modified_base (349)..(349): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttgagtggatgggatggatcagcacttacaatggaaacacaaagtntcgacactaattaactttcccaaagggtaacaagacgttacaacttacaattacgaaacccaacgaacgaacaactactacccaacgacgtaccaaccttcgacccttaaccgagttacgggaaacttacgggaacggggtaaacccttggaacgacgttaccgtacggaaccgtaaccgtaaccgggtaccctttaaagttaacgtttacgttgggtaacggtaaaccggttaaaggtaaaccggttaaaccgttaaaaccgtttccccttaacccgttttaaaccttaaacgttttaaacccgttaaaccgggtaaccgttaaggttaaccggggttaaaggtttcccggtttaacgtttttttaaccgg

SEQ ID NO: 436068 - DNA, 746 bp, Homo sapiens
  misc_feature: GZ8MTXP01BE18A.38.25.C03.1.454.CMB.2.raw
  modified_base (244)..(244): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctctgcaaggtcttntggttaactactttttagctagtttagtggtgtacgaggtcgtgggtgcgacgacggtcccctggaacgaagggtcttggaggtggagtcgggatgggatacgagtactaacttaacaacgtaggaaacaacgtaaagtagtaccgacctaaactaagtttaacgtttaccgaaacgggaccaagggtactcctaagtactaagttacggaaccaacgaacgaacaactaactacccgaacgacgtaccacgttacgaccgtaacgaacgttacgggaaaccgtacgggaaacggggaaacccgttaagggaacgtaacgtacgttaacggaacccgtaaccggtaacccggttactttaaacgttagttttaaacgttgggtaaggtaccggaaaggtaaacccggttaaacgtttaaacgttcccctttaaacttacggttaactttaaccggttacgaacggtaagttagggttagttaacggtttaactttttaacgg

SEQ ID NO: 436069 - DNA, 785 bp, Homo sapiens
  misc_feature: GZ8MTXP01CJNRZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcgagtgaacgtctcctgcaaggcttcgtgttactagttttagctagttatggtgtcgaggtcgtgggtcgcgacgacggccccgtggaacgacgggcttggaggtggagtggggatggggatacgacggtactaactttaacgaagtacggaaactaaacgtaaagtactacggactaactaagttaacgtttccggaaagggggactaaggtacgtaactagtaccacgtaccgaaacccaacgaacgaaccaaactacgtacccgaaacggacgaccctaacggtacctacccgtaacgtaagtaaccgggtaaacgttacgggaaaccggggtaaaccgtagggtaaacgtaccgttacggtaaacccggaaccggtaaccgttaaacccggttacgtttaaacttaaaggtttacgggtttcgggaaacggtacggttaaagggttaaacccgttaaaccgttttaaaaccctttccccgtttaacccttaaaggttaactttaaacgtacggttaaccgtaaggtttagggttaaacggttccgttttcgtttttaaccg

SEQ ID NO: 436070 - DNA, 682 bp, Homo sapiens
  misc_feature: GZ8MTXP01D3KPS.38.25.C03.1.454.CMB.2.raw
  modified_base (291)..(291): a, c, t, g, unknown or other
tcagtcgatcacgtcacgaccggtgctcgatttagtagtgtagatttgggtttggggacccaaaaaccacaccccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagcgtgggtgcgacncggccctaggacgaagggtcttggagtggagtgggatgggatcagtactaactttaacaagtggaaaacaacaaagtatacgacctaaacgtaattaaactttcccggaaagggacaaggtatccaaacgttacaagtacgaaaccaacaacgaaccaacctaacgacccgaacgaacgtaccaacttcgaccctaagtaacgtacgggaaacttgggaaacggggtaaacccgtaggtaaacgtacttacggtaacgaaccggtaacgtaaccgggttacctttaagtatttaagtcgtaagacgttaagaacgttaacgtaaacttcccttacgttacttaagttaagtaccggaactaaggtacggttagttcgttaacctttttaag

SEQ ID NO: 436071 - DNA, 795 bp, Homo sapiens
  misc_feature: GZ8MTXP01DDB3Y.38.25.C03.1.454.CMB.2.raw
  modified_base (278)..(278): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaaggaggccgtggggcctcagtgaacgtctctgcaaggtcttctggttactacttttagctagttatgggtgtcgngtcggtggtcgacgacggccgtccggaggaacggacggtgtaggtaggaggtagggtaggtagtggtactacgacgtactaacgtaagaagtaacgaaactaacgtaaagtcgacgactaaacgtaagtttaaccgtaccggaaggaacgtaaggtactactactacgtacgtaccgaaacaacgaaccgtaacaacgtaccgtaaccgaacgaccctaaccgttaacgtaccctaaccgtaaagtaacgggtaaccggttaaaacggtaccggggtaaaacggttaaccgttagggaaaaccgtttccgtaaccggtaaacccggaaccgttaacccgggttaaacccggttttacttaaagttttaagtttcgggttaaggtaaccgggaagttaaacccggttaaaacgttaacctttaaaacccggttttcccccttaaagtttacttaaaccggtttaaaccgtaacggtaagtaacgggtagttaaacgttcttttaacgttttttaaccg

SEQ ID NO: 436072 - DNA, 709 bp, Homo sapiens
  misc_feature: GZ8MTXP01ADG8L.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgacaaggtcttctggttactacttttagctagttatggtgtcagtcgtgggtgcgtacgacggccccgtaggaccgaagggtcttaggaggtggagtgggatgggatcgagtctaacttaacaaataggaaaacaacgaaagtactcgacaactaattaacgttaccgaaagggtccaagtacgtactatccaagtacgaaccaacgacaaacacactacccgaaggacgtccacgtacacccttaagagtacgggtaaacgtaggaaccgggtaactagggtaacgtaacgttaccgtaggaaaccccgtaacggtaacccgggtttcctttaaaggtttaagtttaccgtttaggaacggtaaccggaaaggtaaaccgttaaacctttaaacctttaccccttacgttaacttaaacgttaagttaaccggaacgttaaaggtaggttaaccgttggtttaaccctttttaag

SEQ ID NO: 436073 - DNA, 668 bp, Homo sapiens
  misc_feature: GZ8MTXP01AEFH7.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacactttttagctagttatggtgtcagcgtgggtgcgacgacggcccctggacaagggcttggagtggagtgggatggatcgaggctacttaacaagtaggaaacaacaaagtatacgacactaattaacttccgaaagggacaagtagtaccatcatacgaaccacacgacacactaccacgtagcctactgaccctagagtacggaaacgtcggaacggggtaacctaggggacaacgttcctacggaacccgtaacgtaacccgggttacctttaagtacgtttagttggtaacggacgttaaacgggtaacttaaacgttaaaccgttttccccttacccgtttaaagttaactttaaccgttaacgtaacggttaaacgttagggttaaaacgtttcggttaacgttttttaacg

SEQ ID NO: 436074 - DNA, 668 bp, Homo sapiens
  misc_feature: GZ8MTXP01AOQ0G.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactactttttagctagttatggtgtcagcgtgggtgcgacgacggccccgtggacgaagggcttggagtggagtgggatgggatcgagctacttaacgaagtaggaaaacacgaaagtatacgacataattaaacgtttcccgaaaggggccaaggagtacatcaatcgaacccaacacgaccaacactacccgaacgagaccaacctgaccctaacgagttacgggaaacgttacggaacgggggtaaaccttggggaacgtacttacggtacgaaccgaacgtaacccgggttacctttaaattagtttaacgttgggtaacgtaacggaagtaaacgttaaaccgtaaacctttcccttaccgttacaatttaacgttacggaacgtagtagggttaacgttgttaactttttaacg

SEQ ID NO: 436075 - DNA, 773 bp, Homo sapiens
  misc_feature: GZ8MTXP01AIWZ2.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggtcttctggttactacttttagctagttagtggtgtcagtcgtggggtcgccggtacgacggtcccccgtgggacgtaaacggggtcttgggacggttggagtgggatacgggatcgaggtctaactttaacgaagtaggaaaacacgtaaaagttactaccggaaccaaccgtaagttaaaccgttttaccggaaaacgggggtacctaacgggtacgttaaaccctaacggtacctaaacgttaccggaaaaccccgtaaacgaaaccgtaacccaaaccggtaaaccgttaccccggaaaacccggaagggttacccctaaacccggttagtaaccccgtaaacgtacggtaaacgggtaaaccgtacggttaaacggggaaacccgtttagggacgtaacttacggacgaccgtaaccgtaccggtacctttagtactttaagtcggtcgacgaagaacgttaacgtaaccttccgttacttagttacgttaacgtacgaagttacgaggttaactcgttaacttttcg

SEQ ID NO: 436076 - DNA, 714 bp, Homo sapiens
  misc_feature: GZ8MTXP01CTLVD.38.25.C03.1.454.CMB.2.raw
  modified_base (338)..(338): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagcgtggcggtagaaggacggccgtggggcctcgagtagtaacgtctcctgacgtaaggtcttcgtggttactacgttttagcttagttagtggtgtacgagcgtgggtgcgacgacggccccgtaggacgaagggtctggtaggnggagtgggactggactcgagactaacttaacaaagtaggaaaaccaagaaaagttataccgactaaagtattaaaccgttaccgaaagggtacaaggtacttacaagttacaacgtacgaaaccaaacgaacgaacaacactacgaacgacgtacacgttacgacccttaagaacgtacggaaacttagggaaacggggtaaccctagggtaaactcgttaaccgacggaaaccgtaccgtaaccggttaccttaaagttattacgttagcgtaacgaaaggtaaacttaaaccgttaaacttcccttaccttaagttacgttaaacgtaacgtaaccgttaaggtaggttaaccgtttcgttaactttttaaccg

SEQ ID NO: 436077 - DNA, 758 bp, Homo sapiens
  misc_feature: GZ8MTXP01BTUEX.38.25.C03.1.454.CMB.2.raw
  modified_base (333)..(333): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagaggccaccatcaactgacaagtccagccagtagttagtttacacgaggtaccaaactaataagtaattactcgcgtacggtaccagacaagaaaccaggaccacgccctaccgtaagtcgactctatttacgngggtacctagttcccggtaccccgggggtacggttaccccgggggtccctacggtaacccgtacgttaccggacggtccgggtaccgacggggtcccggggttactcgggtaaacggtaaccgtaggtacttttacccaccttacctacctaccctaacgttccgacggtaccgacggtacccgtcggtaccggtacgggtaccgtacgggaaacgtaacgttgggtacgggttacggtttaaaggtttttaacttaccgttacgtaccgtagtacgttaagtttaactttagttaaggttaccgttccgttacggtaacggtttccggttttaccgggggaacccggggttaaccgtaaacggtcggttacggacgttacgtaaccgtaaacggtaacgtgggtacgcgtaaccgccgtaaccg

SEQ ID NO: 436078 - DNA, 655 bp, Homo sapiens
  misc_feature: GZ8MTXP01C4CW1.38.25.C03.1.454.CMB.2.raw
  modified_base (610)..(610): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttctggttactacttttagctagttatggtgtcagcgtgggtgcgacgacggccccgtaggacgaagggtcttggaggtggagtgggatggatacgagactactttaacgaaagtaggaaaacaactaaaggtactacgacaaactaattaaacttcccgaaaggggacaaggtaacgtcaaattacgatacgaaccaagaacgaaccacaacgtacccgaagacgacacgtcgacccctagaacgttggaaacttggaaacggggaaacctggaaagtcgtacgtacggaacgacgtaaccggtcctttaaagttaacgtttacgtggtaacgacgaaagtacgaaacttaaacttcccttaaccgttanaattaacgtaaccgaagtagtagggttaacttgttcgtttttaag

SEQ ID NO: 436079 - DNA, 667 bp, Homo sapiens
  misc_feature: GZ8MTXP01ACE6I.38.25.C03.1.454.CMB.2.raw
  modified_base (291)..(291): a, c, t, g, unknown or other
  modified_base (619)..(619): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggccgtggggcctcagtgaacgtctcctgcaaggtcttctggttactacttttagctagttatggtgtcagtcgtgggtgcgacncggcccctggacaagggcttggagtggagtgggatggatcgagcaactttaacaagtaggaaaacaacaaaggtatacgactaacgtaattaaacgtttcccgaaaggggtccaaggtacgtactaaagtctaatacggaaaccaaacacgtaaacaacacgtacccgaacggagaccaactcgacccttaacgaagtacgggaaacttacggaacggggtaaacctggaacggtactacgtacggaccgacgtaaccggtactttagtaagtttattggtaacgcgttaaaggaacgttaaacgtaaaaccgttcccttaaccgttnaaattaacgtacgtaacgtagtacggttaatttgttaactttttaacg

SEQ ID NO: 436080 - DNA, 631 bp, Homo sapiens
  misc_feature: GZ8MTXP01BQQ80.38.25.C03.1.454.CMB.2.raw
  modified_base (452)..(452): a, c, t, g, unknown or other
  modified_base (621)..(621): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagcgtgggtgcgacgacggccccgtaggacgaagggcttggaggtggagtgggatggatcgagcactttaacgaagtaggaaacacgaaagtatacggacaacattaaactttccgaaagggacaaggagtacatcaatacgaccacacgacacactaccgaacgagaccacgtcgacctanagtaggaaactcggaacgggtaaccgtggaacgtacttcgacgaaccgaccgtaaccggttacctttaattagtttaagttggtaacgtaacggttaagaacgttaacgtaaactttccccttacgttacaattaacgttacgaacgttagtacgggttaattcggttntttttaaccg

SEQ ID NO: 436081 - DNA, 692 bp, Homo sapiens
  misc_feature: GZ8MTXP01AVE6U.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcgagtcgtggtgcgacgacggtcccgtaggacgaagggtcgtaggaggtggagtgggatggatcgagtactaacttaacgaaagtaacggaaactaacgtaaagtactaccgactaataacgttaaacgtttcccggaaagggtaacctaaggtacgtacctaaagtactaacgtacgaaaccgaacaacgacaaacctacacccgaagacgaccacgtacgacctagacgtacggaacgtaggaacggaacgtagtaagtacgtagtaaccgacgtaaccgtaccgttaccttaagttattacggtggtaacgtacggttaaataaccggttaacttaaaccggtttcccttaaccgttacttaacgttaagtaccgtaaggtacgttacggggttaatttcggttaactttttaacg

SEQ ID NO: 436082 - DNA, 666 bp, Homo sapiens
  misc_feature: GZ8MTXP01A5CAK.38.25.C03.1.454.CMB.2.raw
  modified_base (624)..(624): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagcgtgggtgcgacacggcccctggacgaagggtcgttgaggtggagtgggagtggatcaggctaacgtaacgaataggaaacacgaaagtacgtacgacaagtaattaaactttcccgaaaggggtcaagtacgtactactacgaatacggaaaccaacaaacaacaaccaactaccgaacgacgacctaacgtcgacccgttaacgaacgttaacgggaaaccttacgggaaacggggtaacccgtaggtaaccgagttacccgagtaaccgaacgtacccggtaccttaacttagttaagttgtaacggacgaacggtaacttaactaaacgttacccttaccgttanaactaacgtacgaacgtagtaggttaagtcttgtttttaacg

SEQ ID NO: 436083 - DNA, 651 bp, Homo sapiens
  misc_feature: GZ8MTXP01AH0Z9.38.25.C03.1.454.CMB.2.raw
  modified_base (219)..(219): a, c, t, g, unknown or other
  modified_base (454)..(454): a, c, t, g, unknown or other
  modified_base (601)..(601): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctnagtgaacgtctcctgcaaggtcttcgtggttactacttttagctagttatggtgtcagtcgtggtgcgtacgacggccccgtaggaccgaagggtcttaggaggtggaggtgggagtggattcgagctaacttaacgaaagtaggaaaactacgaaaagtactacggacctataaattaacgtttacccgaaaggggtaaccaaggtacgtacaagttccaagtacgaaacccanaaacgaacaacctacaccgaaccgagaccacgttacgacctactaacgtacgaaacgttcgaacgggtaaccgtagagtactacgtagacgacgtacgtcttattattagtgtaacgagagtacgaaacttaacttccttacgttanacttaacgtaccggaagttaagtagggttattaacgttcgtttttaaccg

SEQ ID NO: 436084 - DNA, 647 bp, Homo sapiens
  misc_feature: GZ8MTXP01BGQNI.38.25.C03.1.454.CMB.2.raw
  modified_base (467)..(467): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacgaggccccgtggacgaagggtcttggaggtggagtgggatggatcgagtctaacgtttaacaaagtaggaaaacaagtaaagtatcgacaactaattaaacgtttccgaaagggcaagtagtacatacatacgaaccaacacgaacaacaactaccaacgacgacctactcgaccctanagtagaacgtaggaacgggaacgttagaagtacgtacgtacggaacgacgaaccggttaccttaattatttagtggttaacgacgttaagtaacgttaaacgttaaacctttcccttaccgtttacaagtttaaacttacggaacgtagtacggttaagtttcgtttaacgtttttaacg

SEQ ID NO: 436085 - DNA, 722 bp, Homo sapiens
  misc_feature: GZ8MTXP01D5ZZY.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactactttttagctagttatggtgtcagcgtgggtgcgacgacggccccgtaggacgaagggtcttaggagtggagtgggatggatcagactaacttaacaagtaggaaaacacaaagtatacgacaactaattaaacgtttccgaaagggtcaaggataccaattcaatacgaaccaacagaacacacaccgaagacgaccactcgacctaacgacgtacggaacgttacgggaacggggtaaacccgtaggtaacgtaacgttaccggtaacggaacccggtaaccggtaaacccgggttacctttaaagtttaacgttttaggttcgggtaagtaacgggttaaacgggtaaaccgttaaaaccgttaaaacccttttacccgttaacccgtttaaacttaacgtttaacgtttaaaccggaaccgttaaggtacgggttaagtttaacggttttaacttttttaaccgg

SEQ ID NO: 436086 - DNA, 703 bp, Homo sapiens
  misc_feature: GZ8MTXP01B54AH.38.25.C03.1.454.CMB.2.raw
  modified_base (334)..(334): a, c, t, g, unknown or other
  modified_base (346)..(346): a, c, t, g, unknown or other
  modified_base (352)..(352): a, c, t, g, unknown or other
  modified_base (378)..(378): a, c, t, g, unknown or other
tcagtcgatcacgtcacgaccggtgctcgatttagtagtgtagatttgggtttggggaaccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacacggccctggacaaggcttgagtggagtgggatggatcagcacttanaataggaaacanaaagtncgacactataacttccgaaggcaagngtacatcatacgaccaacagacacgactccgaacgagaccactcgaccctaacgacgtagggtaaacctaggggaacggggtaaacccgttagggaacgaacgtttaccgtaacggaacccggaaaccggttaccgggtaccttttaaagttaacgttttaaaggtttgggttaacggacgggttaaacggtaaacggttaaaccgtttaaaaaccgttttcccctttaacgtttaaacccgttaaagtttaaccgtttaaaccggggaaccgtttaagggtaaccgggttaaggttttaacggttccctttttttttaaacggg

SEQ ID NO: 436087 - DNA, 637 bp, Homo sapiens
  misc_feature: GZ8MTXP01B4JZV.38.25.C03.1.454.CMB.2.raw
  modified_base (337)..(337): a, c, t, g, unknown or other
  modified_base (356)..(356): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacgaagggcttggagtggagtgggatggatcagcacttanaagtaggaaacacaaagtntcgacatataattccgaagggcaagacgtacatcatacgacacagacaacactaccgaacgagaccacgttacgacccctaaacgagttaacgggaaaccttacgggaaacgggggtaaacccttaggggaaacgtacgttaccgtaacggaaccgacgtaaccgggtaccctttaagtactttagttcgtaagtaacggaaggtacaaaccgttaaacttcccttaccgttattaacttaagtaaccgaagtaagtaggttattcgttaactttttaacg

SEQ ID NO: 436088 - DNA, 692 bp, Homo sapiens
  misc_feature: GZ8MTXP01DP99N.38.25.C03.1.454.CMB.2.raw
  modified_base (258)..(258): a, c, t, g, unknown or other
  modified_base (316)..(316): a, c, t, g, unknown or other
  modified_base (330)..(330): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatacaactgacaacgtccagccagtagttgtttacagacgtaccaaanaataagtaattactcgctaggacagacaacgaaccgaggacacgtcctactaagttcnctactaatttacgnggactacgtaccgaccggggtacgtcccgggtccacggaccgtactcgacggcggcgacggtccgggtctggaacgactaagttacttaccgactacctaccactactacgacgacacgacctgaccgaggtacgtagaaagtgtcggttacggtacggtttaagttttacgttacgttacggtactaagtaccgttaagtttaaagttacgttaacgttaccggttaccgttacggtaacgggtttaccgggttttaccgggggacccgggggttaaacctaacgggtacggttagggttaaacgttaccgtaaacgtaaacggtaacgttcggtcggttacgtaaccggaaccttaaccg

SEQ ID NO: 436089 - DNA, 654 bp, Homo sapiens
  misc_feature: GZ8MTXP01B8IHA.38.25.C03.1.454.CMB.2.raw
  modified_base (522)..(522): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacgacggcccctaggacgaagggcttggagtggagtgggatggatcgagctactttaacaagtacggaaacaacgtaaagtatcgaccacgtaattaactttcccgaaagggacaaggtagtcaagttacagtacggaacccacaacgacaaccgactaccaacggacgacctacgtacgaccctaacgacgtacggtaactgggaacggggtaacccgtaggaagacgttaccgnggaacccgtacgtaccggttactttattagtttcgttaggtaaggacgttaagtaacgttaacttaaacctttccttaccgttacttattaagtaaccgaagtacgtacgggttattcgttcgtttttaacg

SEQ ID NO: 436090 - DNA, 646 bp, Homo sapiens
  misc_feature: GZ8MTXP01BLTGQ.38.25.C03.1.454.CMB.2.raw
  modified_base (514)..(514): a, c, t, g, unknown or other
  modified_base (564)..(564): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggtcttctggttactacttttagctagttatggtgtcagtcgtgggtgcgacgacggtccccgtaggaccgaagggtcgttaggaggtgggagtgggatgggactcgacgtactaacgtttaacaaagtaggaaacaacgtaaagtatacgactaataattaacgttaccgaaagggacaagagtacatacacgtacgaaccacgacgaaccaccacgtaccgaacgacgacctacgtacgaccctaagacgtacggaactagggaacgggtaacngggaactacgttacgacgtaaccgacgtacggtacttagttattagtggngtacgagtaacttacgtaaacttcccttacgttacttagttaacgtacgaagtaggtcggttaagttgttaactttttaacg

SEQ ID NO: 436091 - DNA, 706 bp, Homo sapiens
  misc_feature: GZ8MTXP01C0WQ5.38.25.C03.1.454.CMB.2.raw
  modified_base (497)..(497): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagcgtggcggtagaaggaggccgtggggcctcgagtgaacgtctccgtgcaaggtcttcgtaggttactacgttttagctagttatggtgtcgagtcgtgggtgcgacgacgggcccctaggaacgtaagggtcttaggaggtggagtgggaatggatacagactaacttaacaagtacggaaaacaacgaaagtataccgactaactaattaacgttcccgaaaggggacaaggtaacgtcaaattacgaagtacgaacccaacaagaaccaacacaccgagacgacctaccgtgaaccctaanaacgtacggaaacgttacggaacggggtaaaccgtggaaacgtacgtacgtaaccgaacgaccgtaacggttccttaaagttattagttggtcgaacgttaggaaacttaaaccgttaaacgtttacccttaacccgttaaattaacgtttaaacgttaaccggaacgttaaggtaggttaacgttaacggtttaacgttttttaaccg

SEQ ID NO: 436092 - DNA, 714 bp, Homo sapiens
  misc_feature: GZ8MTXP01AD8OY.38.25.C03.1.454.CMB.2.raw
  modified_base (333)..(333): a, c, t, g, unknown or other
  modified_base (346)..(346): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagcgtgggtgcgacgcggcccctggacgagggtcttggagtggagtgggattggactnagtactacttaanaagtacggaaacaagtaaagtactcgacactaagttaacgttcgaaagggactaaggacgtacatactagacgaaccgaacacgaacaccaactacccgaaacgacgaacctacgtcgtacccgtaacgacgttaacgggaaacccgttagggaaaccgggggttaaacccgtaggggtaaacctaacgttaccggtaaacccgggaacccgtaaacccgttacccggttaacctttaagttaactttagttacggtaagaacggttaaacgtaacgttaaacttaaacgtttccccttaacgttacccttaatttaaaccgtacgtaactaagggttacgttacggtttaatttcccgtttttaagg

SEQ ID NO: 436093 - DNA, 755 bp, Homo sapiens
  misc_feature: GZ8MTXP01B2D81.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacgacggccccgtaggacgaagggcttggagtggagtgggatgggatcgagactaacttaacaagtaggaaaacaacgaaaagtatacgaccaactaattaaacgtttcccgaaagggtacaaggtacgtacatacaagtacgaaccaacacgacaacactaccaacgacgacctaactacgaccctaacgacgtaacggtaaacgttacgggaaacgggggtaaacccgttaggaaacgtaacgtttacccggtaacgtaaacccggaaccgttaaaccccgggttacctttttaaacttaaacgtttttaaacggtttggtaacgggttaaaccggaaagggtaaaaccgttaaaccgttaaaaaccgttttccccgtttaaacccgtttaagttaaactttaaccgtttaaaccggaaccggtttaaacgtaggggttaaacgtttcggtttaacttttttaaccgg

SEQ ID NO: 436094 - DNA, 673 bp, Homo sapiens
  misc_feature: GZ8MTXP01ANN1Y.38.25.C03.1.454.CMB.2.raw
  modified_base (373)..(373): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagtcgtgggtgcgacgacggccccgtaggacgaagggcttggaggtggagtgggatggatcgagctaacttaacaaagtaggaaaactaagaaagttanacgacaataattaacgttccgaaagggacaagacgtacaatacaagtacgaaccaacaacgaacaactaacaccgaacgagaccacgtacgaccctaacgacgtaacggaaacgtacggaacggggtaaccgtaggaagtacgttacgaacggaaccgaaccgtaaccgggtaacctttaagttaagtttagttcggtaaggtaaccggaaagtaaacgttaaaccttaaactttccccttacgttacttaacgttaacgtaacgaacgtaagtacggttaacgttcgttaattttaacg

SEQ ID NO: 436095 - DNA, 653 bp, Homo sapiens
  misc_feature: GZ8MTXP01B1Y7C.38.25.C03.1.454.CMB.2.raw
  modified_base (416)..(416): a, c, t, g, unknown or other
  modified_base (431)..(431): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagcgtgggtgcgacaggcccctggacaagggcttgagtggatgggatggatcagcacttacaataggaaaacacgaaaagtatcgacaacaattaaactttcccgaaaggggaccaaggagtccaataccaatacggaacccaanaacggaacaacaacnccaacgacgacactgaccctaacaagttacggaaacttggaaacgggggtaaaccttagggaacgtaactaccgtagaaaccggaaccgaaccgggttcctttaaagttaactttaagttggtaagacgttaaggaacgttaaaccgtaaaatttccccttacgtttaaccatttaacgttaccgaacgtaagtgggaaacgtttggttaactttttaaccg

SEQ ID NO: 436096 - DNA, 669 bp, Homo sapiens
  misc_feature: GZ8MTXP01A66G8.38.25.C03.1.454.CMB.2.raw
  modified_base (340)..(340): a, c, t, g, unknown or other
  modified_base (424)..(424): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggccctggacgaagggtcttgaggtggagtgggatggatcgagctacttanaagtaggaaaacacaaaagtatcgacctaacgtattaaacgtttcccgaaaggggccaaggacgtacatcaagtcgaacccaanacgaacaacactccgaacgagaccactcgtacctaacgagtaacgggtaactagggaacggggttaaacccgtaggaacgtacgtaccgtacgaacggtaacccgtaaccgggttacctttaaagttagtttaaccgttggtaacggaacgttaaggaaacgttaaccttaaaacttccccttaacgtttaaccttaaattaacgttaacgaacgtagttacggaagttcgttaactttttaacg

SEQ ID NO: 436097 - DNA, 665 bp, Homo sapiens
  misc_feature: GZ8MTXP01AMB2K.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggtcttctggttactacttttagctagttatggtgtcagtcgtgggtgcgacacggccccgtggacgaaggcttggagtggtagtgggatggatacgacgtcaacgtttaacgaagtaggaaaacaacgtaaagtatacgacaaactaagttaacgtttacccgaaagggtacaagactaccgattacaatacgaaccaacgacgaacaacgactacccgaacgtacgactacgtcgactaaccgaagttacggaacctaggaacgggtactaggaagtactcgtacgaacgtacgaaccggttaccttaattacgtttaagtgtaacggtaacgagggtaacttaaacgtaaacctttcccttaaccttaagttaacttaacgttacggaacgtaagttagggttacgttaacgtttaacttttaacg

SEQ ID NO: 436098 - DNA, 642 bp, Homo sapiens
  misc_feature: GZ8MTXP01A5HHF.38.25.C03.1.454.CMB.2.raw
  modified_base (567)..(567): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggccgtggggcctcgagtgaacgtctcctgcaaggtcttctggttactactttttagctagttatggtgtcagcgtgggtgcgacgacggcccctaggacgaagggcttaggaggtggagtgggatgggatcgagactaacgttaacaagtaggaaaacaacgaaagtactacgacaactaattaaacgtttcccgaaagggactaaggacgtacacttacaacgtacgaaacccgacaacgaccaactaacgaccgaacgacgtaccaccgtacgacctaacgaagtaacggaacgttacggaacggtaacgtagtaacgacttaccgagaccgacgtacggtactttaagtattagttggnacgttagacttacgtaaacttccttacgttacattaagtaccgtaagtatacggttagttcgttaacgttttaag

SEQ ID NO: 436099 - DNA, 593 bp, Homo sapiens
  misc_feature: GZ8MTXP01A008F.38.25.C03.1.454.CMB.2.raw
  modified_base (425)..(425): a, c, t, g, unknown or other
  modified_base (437)..(437): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacaagggcttgaggtggagtgggatggatcagcacttaacgaagtaggaaaacaacgaaagtatacgacaactaataactttccgaaagggcaagagtcatcatacgacacagacacactccacganacactgacctanataggaactggaacggggaacctaggaacgactcgtacggaacgacgaccggttccttaattactttacgttggtgacgttaagaacgttaacgtaaactttcccttaccttacacttaattaccggaagtagtaggttagttcgttcgttttaag

SEQ ID NO: 436100 - DNA, 599 bp, Homo sapiens
  misc_feature: GZ8MTXP01ASVZO.38.25.C03.1.454.CMB.2.raw
  modified_base (436)..(436): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttactggtgtctagtcgtgggtgcgacgacggcccctggacaagggcttgagtggatggatggatcagcatacaagtgaaacacaaagtctgacacgtaattaacttccgaaagggtcaagacgtacatcatcggaacacgatacactacgccacgtagcactgaccctaanagtacgacgtacggaacggacgtgactacgtacgacgacgacgtacgtacttaagttagttgtggaacgacgaagtacttaaaccgttaacttacccttacgttacgttaacgttaacgtaacggtaagtaacggttaggttacgttcgttaacgttttaacg

SEQ ID NO: 436101 - DNA, 744 bp, Homo sapiens
  misc_feature: GZ8MTXP01CEPUM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagcgtgggtgcgacacggcccctggacaagggtcttggagtggagtgggatggatcgagctaactttaacaagtaggaaaacaacgaaaagtatacgactaactaatttaaacgtttcccggaaaggggtacctaaggaacgttacaacgttacagtacgaaccaacacgaacacactccgaacgacacacctacgacctaacgagttaacggaacgttaggaaacggggtaaacccgttggaacggtaacttaccgtaacggaaacccgaaccgtaaaccggggttaccctttaaattacgttttaagttcgggttaacggaacccggttaaaggtaaaccggttaaaccgttaaaaccgttttccccttaaaccggttttaaacccttaaagtttaaaccgtttaaccggtaaaccgttaacggttaaggggttaaaacgtttcggttaacgttttttttaaaccgg

SEQ ID NO: 436102 - DNA, 657 bp, Homo sapiens
  misc_feature: GZ8MTXP01AR6TP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatgggtgtcgagtcgtgggtgcgacgacggcccctaggacgaagggcttggagtggagtgggatgggatcgagctaacttaacaaagttacggaaaacacaaaagtatacgacaacgtaattaaacgttccgaaagggacaagagtcaatcatacgaacacgacgaacacactaccacgacgtacaaccgtgaccctaagacgtacggaaactacgggaacgggtaaacctaggaacgtacgtacgtacggaaccgtaaccgtaaccgggttaccttttaatagtttacttggtaacggacgttaaagaaacgttaaccgttaaactttacccgttaccttacacttaagtaacccgtaagtacgtaggttagttcgttcgtttttaacg

SEQ ID NO: 436103 - DNA, 736 bp, Homo sapiens
  misc_feature: GZ8MTXP01AP5ND.38.25.C03.1.454.CMB.2.raw
  modified_base (287)..(287): a, c, t, g, unknown or other
  modified_base (458)..(458): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctctgcaaggtcttctggttactacttttagctagttatggtgtcagctgggtgcgacncggccctggacgaggcttggagtggagtgggatggactacgagactacgtttaacgaagtaggaaaacacaaaagttatcgactaataagttaaacgtttcccgaaaggggcctaaggacgtacatacagtaccgaaccaacaagacccaactacgtacccgaacggtaanaccgtacgttacggacccttaacgtaacgtaccgggtaaacgtacgggaaacgggggtaacctaggaaccgtagtaccggtaacgaaccgaccgttaaccgggtacctttaaggtaagtttaccgttacgggtaacgtaaccggttaaagggtaaccgttaaacccttaaaccgtttccccttaacccggtttaaaccgttaaactttaaaccggttaacggtaaccgtaaacggttagggggttaaactttcgggtttaacccgttttttaacccgg

SEQ ID NO: 436104 - DNA, 717 bp, Homo sapiens
  misc_feature: GZ8MTXP01CGRDJ.38.25.C03.1.454.CMB.2.raw
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcagtgaacgtctcctgcgtaaggcttctggttactactttagctagttatggtgtcaggtcgtgggtgacgacgacggccccgtaggacgaagggtcgttaggaggtggagtggggatgggatcgagtactaacgtttaacgaaagttaggaaaacaacgtaaagtagtacgacctaaagtaactttaaacgttacccgaaaggggtacaaggtaacgtacaacgttacaagtaccggaaaccaacgaacgaacaaccacgtaacccgaacgacgaccctacgtacgtaccctaagacgtaacggaacgttacgggaacggggtaactagggaactaacgttaccgtaacgggaacctaccggtaaccggttacgtttaattaagttacgttggtaaccggtaagaacggtaaacgttaacttaaacctttcccttaaccgttaaacttacgtttaacgtaaccgaagtagtaggttaattcgttaactttttaacg

SEQ ID NO: 436105 - DNA, 596 bp, Homo sapiens
  misc_feature: GZ8MTXP01BOERY.38.25.C03.1.454.CMB.2.raw
  modified_base (400)..(400): a, c, t, g, unknown or other
tcagtcgatcacgtcacgaccggtgctcgatttagtagtgtagatttgggtttggggacccaaaaacccacacccctccttgggagaatcccctagatcacagctcctcaccatggactggacctggagcatccttttcttggtggcagcagcaacaggtgcccgactcccagcttcaattggtgcagtctggagctgcggtgaagaggcctggggcctcagtgaacgtctcctgcaaggcttctggttactactttttagctagttatggtgtcagtctgggtgcgacgacggccctggacagggcttggagtggatgggatggatcgagcacttacagtcgaaacacgaaagtactgacactataacttccgagggcaacgagtctatcgatgaccanagacacactaccgagacgcaccgtcgacctaccgactacggaacctcgggggaacggaaacccctaggaacgtaacgttcgtaccggaaaccggtaccgaccgggtaccttattacgtttacgttgtacggttacgagacgaacctaagttcccttaccgttacaagttactaacgacgattgggtaattgttaac

SEQ ID NO: 436106 - DNA, 706 bp, Homo sapiens
  misc_feature: GZ8MTXP01EQT40.38.25.C03.1.454.CMB.2.raw
  modified_base (428)..(428): a, c, t, g, unknown or other
  modified_base (445)..(445): a, c, t, g, unknown or other
  modified_base (458)..(458): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaggcttctgttacacttttagctagttatggtgtcagtcgtgggtgcgacgacggccccgtaggacgaagggcttaggaggtggagtggggagtgggatacaggctaacgtttaacaagtaggaaaacaacgaaagtatcgactactaagttaattcccgaaagggacaagacgtacatacatacgaccaanacgacacataccacganacactgaccctanactacgggaaactcggaacgggggtaacctggaacgtacgttacgaacggaaccgtaaccggtaaaccgggttaccttttaattaaacgtttcggttttaggtaacgggaacgttaaagggtaaccgttaaaaccgttaaaaacctttttccccgttaaacccgtttaagttaaactttaaccgtttaaaccggaacggtttaacgggtcggtttaaaacgggttttcgttttaaccgttttttaacg

SEQ ID NO: 436107 - DNA, 922 bp, Homo sapiens
  misc_feature: GZ8MTXP01B8G7F.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctggcggtgaaggaggccgtggggcctcgagtgaacgtctcctgcaaggtcttctggttactacgttttagctagttatggtgtcagtcgtgggtgcgacgcggcccctggacgaagggtcttggagtggagtggggatgggactacgaggtctaacgtttaacgaagtaacgggaaaacaacgtaaaaggttagtaccggactaaacgtaaacgtttaaaacgttttacccgggaaaagggggttaacccgaaggttaaacgggttacccgtaaaatttaccccgtaaaaggttaacccgggaaaacccctaaaaccgaaaccggtaaaccctaaaaccctaaccgtaaccccggaaaacccgggtaaacggaacccttaaacccgtacccggtaacccctttaaaccgaaaggttaacggggaaaacccgtttaacggggaaaaccccggggggttaaaccccggttaaaggaaaacggtaacccgttaacccggtttaaaccggaaacccggttaaacccggttaacccggggtttaacccttttaaaaggttaacttttaagtttaacggggaacgggtaaccggttaaacgtaaacgggttaaacccgttaaaaaccgtttcccgtttaaacccttttaacttaacgttttaaaaccggttaacccgtaaacgggttaacggttacgggttaaaaggtttccggtttaacgttttttaacccg

SEQ ID NO: 436108 - DNA, 768 bp, Homo sapiens
  misc_feature: GZ8MTXP01BPZJG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggccccgtggacgaagggcttgagtggagtgggatggatcgagctacttaacaagtaggaaaacacaaagtactacgacaactaattaaactttcccgaaaggggtacaagtagtaccattaccaatacgaacccaactaacgaaccaaccaacgtacccaacggacgacctaaccgtcgtaacccttaacgaacgttacgggaaacttacgggaaacgggggtaaacccgttaggaacgtaacgtttacccgtaacgggaacccgtaaccggtaacccggggttacccttttaaagtttaaaccgttttaacggttagggtaaccggtaacggttaaacggtaaacgttaaacccgtttaaaaccgttttccccgttaaaccccgttttaattaaacttttaaaccggttttaaacccggaaggtttaaccggttagggttaaaaccggttttcggttttaacccgttttttttaacg

SEQ ID NO: 436109 - DNA, 702 bp, Homo sapiens
  misc_feature: GZ8MTXP01BOAN1.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcagtgaacgtctcctgcaaggtcttctggttactacttttagctagttagtggtgtcagtcgtgggtgcgacgacggccccgtaggacgaagggtcttggaggtggagtgggatcggatcgagctaactttaagaagtacggaaaacaacgaaaagttctacgactaaactaagttaaacgtttccggaaaggggacctaaggtacgttactaaactacgaagtaccgaaaccaaacgacgaacaaccgtaacacccgaaacgacggtaccctaacgtaccggtaccctaaagtaacgtacgggtaaacgttacgggaaaccggggtaaaccgtaggtaacgtacgtaccgtaacgaaccgaaccgtaacggttacctttaagtactttagtgtaacggaagaaggtaaacgttaacgtaaacttcccttaacttacgttaattaacgtacgaagtagttaggactttgttcgtttttaacg

SEQ ID NO: 436110 - DNA, 587 bp, Homo sapiens
  misc_feature: GZ8MTXP01AG0LQ.38.25.C03.1.454.CMB.2.raw
  modified_base (411)..(411): a, c, t, g, unknown or other
  modified_base (422)..(422): a, c, t, g, unknown or other
  modified_base (480)..(480): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagcgtagggtcgcgacgacggcccctggaccaagggcttggagtggatggggactggatcaggactactttaacgaagtacggaaacacaaagtctcgacacataacttccgaagggcaagagtcatcatagaccaanacgaacactanccaagagacacgttcgccctagactggaactcgaagggggtaaccctggaactagtcngaccgacgtacggtccttaataccttaagttggaactacggagtaacactaaacttccttcttaacataagttacgaacgtatagggttaatcgttaacttttaacg

SEQ ID NO: 436111 - DNA, 823 bp, Homo sapiens
  misc_feature: GZ8MTXP01EGW8J.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttctggttactacttttagctagttatggtgtcgagtcgtgggtcgcgacgacggtccccgtaggacgaagggtcttggagtgggagtgggattggactcgacgtacctacgtttaaacgaaagttacgggaaaacctaacgtaaaaacggttacttacggaaccctaaaactaaacgttttaaacgtttaccccggaaagggggtactaacgggtaacgttacctaaacgttacaaacgtacggaaaccaaacaacgaaccaaacgaactaccccgaacgaacgaccctaacgttacgacccgtaacgaaacggttaagggaaaccgttacgggaaacggggggttaaaccctaggggtaaacgtaaccgttaccggtaacggaaccccggtaaacgtaacccgggtttacccttaaagttttaaagtttaccggttgggtaacggttaacggaaacggtaacgttaaaacccgttaaaccgtttcccgtttaaaccgttaacccttaaagtttaacgtttaaaccggaaccgtaaaggttcggttaaaagggttttcccgtttaagttttttaacccgg

SEQ ID NO: 436112 - DNA, 657 bp, Homo sapiens
  misc_feature: GZ8MTXP01CGBOL.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgcggcccctggacgagggtcttggaggtggagtgggatggatcgagctaactttaacaagtacggaaacaactaaagtatcgacactaagttaacttccgaagggacaagacgtacatcatcgaacacagactacactaccaagacgacacgtcgacctacgacgtaaggacgtacgggaaacggggtaacctaggtaacggtaactccggtaacggaaccgtaacgtaaccgggttacctttaagttactttaggttcgtaacggtacggaagtaacgttaaaccgttaaacgttccctttaaccttacttaacgtttaagtaaccggtaacgttaaggtagggttaacgttcgtttaacttttaacg

SEQ ID NO: 436113 - DNA, 752 bp, Homo sapiens
  misc_feature: GZ8MTXP01AV7D9.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcaggcgtgggtgcgacgacggcccctggacgaagggtcttggagtggagtgggatggatcgagcaactttacaagtacggaaaacacaaaggtataccgactactaattaattcccggaaaggggtaccaagtagtaccagtcaacgtacgaaccgaaacagaaccactaacacccgaacggacgaccacgttacgacccttaaagaacgttacgggaaacttacggggaaaccggggtaaacccgttaagggaacggtaactttaaccggtaccgggtaaacccggaacccggttaaaccggggttaccttttaaacgttaacgtttttacgtaggggttaacggaaccggtttaaagggaaacggttaaacccgttaaaacgtttccccgttaaactttaacccgttaaggttaactttaaaccggggaaccgttaaggttacggggttaaccgtttaaggttttcccgtttttaacg

SEQ ID NO: 436114 - DNA, 888 bp, Homo sapiens
  misc_feature: GZ8MTXP01BYMW6.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgccgtacggggacatcgtgatcgacccagtctccagacctccctggctgtcgtctcgtggcgagacgggccaccatcaactgacaagtccagccagtagttgtttaacactacggtaccaaacaataaagtaactttaccgtcgtacgtacggtaaccagacgaaacgaaaccgaggaaccacgtccccttaccgttaaagttcgaccttacgtaacgttttaacgtcgggggtacctaaccgttacccgggtaaccccgggggtacgggtttcccccgggggttaccctacgggtaaccccgttacgtttacccggaacggggtcccgggtaccggtaacggggtcccggggttacccttaagggaaaccgggtaaacccgttaaggggtttaacccttttaccccggtaaccttaccctaaccccgtaaacccgtaaacttccggaaacggttcccgaaaccgttcccggttacgggaaccgtaacggggtaccgttaaagggaaaacgttggttacggggtttacggtacgggttttaaacggtttttaacgttaccttagggttacccaagttacgtaaagtttaacgtttagttaacgtaccggtttaccctacggttaacggtttacccgggttttacggggggaacccgggttaaaccgtaggtacgggttacggttaacgttaaacgttaaccgaaacgggttaaccgtcgggttacgggaccttaaccggccgttaaaccg

SEQ ID NO: 436115 - DNA, 678 bp, Homo sapiens
  misc_feature: GZ8MTXP01AMFGI.38.25.C03.1.454.CMB.2.raw
  modified_base (357)..(357): a, c, t, g, unknown or other
  modified_base (464)..(464): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtctttcgtggttactacttttagctagttagtggtgtcagcgtgggtgcgacgacggccccgtggaacgtaagggtcttaggagtgggtagtgggagtggatcgagtctaacttaanaagtaggaaaacaagaaagttatacgacaataattaacttcccgaaagggacaagagtaccaatactaatacgaaaccaacgaacgacctaacactaccaaacgganaccactagacccctaagaacgtacggaaacgttacgggaacggggtaaccaggtaacgacttccgaacgaaccgaccgtaaccgggtacctttaagttagttacttgggtaacgtaacggaacgtaacgttaaacccttaaacttccctttaccgttaacttagttaaccgtacgtaacggtgtagggttaaactttcgttaacctttttaacg

SEQ ID NO: 436116 - DNA, 637 bp, Homo sapiens
  misc_feature: GZ8MTXP01AJO9D.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagcgtgggtgcgacgacggcccctggacgaagggtcttggaggtgggagtgggagtggatgagcaacgtttaacaagtaggaaacaacgtaaagtatacgacactaattaactttccgaaaggggtactaaggacgtactaactcgaactaggaaccaacaacggaacaaccgtaactacccgaaggtaacaccaaccgttcgaccttaacacgtaacggaaactaggaaccggggtaaccgtagacgtacgtacgtacgaaccgacgtaaccggtctttaatagtttagtcgtgaacgagtaacaacgtaaacctccttacttacttagtaactaagcgtagtaggttattgttcttttcg

SEQ ID NO: 436117 - DNA, 720 bp, Homo sapiens
  misc_feature: GZ8MTXP01E4G91.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttacacttttagctagttatggtgtcagcgtgggtgcgacgacggcccctggaacgaagggtcttggacggtggagtgggatggatcagcacttaacgaataggaaacacgaaagtatacgacaagaattaaacgttccgaaagggcaaggtacgtactactacagtacgaaaccgaacaacgaacaaccacgtacccgaaacgacgaccacgttacgaccctaactaacgtaacgggaaacctagggaaacggggtaacctaaggaacggttactacgtacggaaccgtaaccgtaacggtccctttaaagttagtttaaacgttcgggtaacgtaaccgggaaggtaaaccggttaaacccgttaaaaccgtttccccttaaacccgtttaaacttaacgtttaaaccgtaacggtaaacccggttaagtaggggttaaacggtttaaccgtttaacgtttttttaaccggg

SEQ ID NO: 436118 - DNA, 685 bp, Homo sapiens
  misc_feature: GZ8MTXP01AF91L.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcgagtgaacgtctcctgcgaaggtcttcgtggttactacttttagctagtttactggttgtcgaggtcgtgggtcgcgacgacggcccccgtggacgtaagggcttggaggtggagtgggagtggatcgagactaacttacgaagtaggaaacacgtaaagtactacgacaactaagttaactttccggaaagggtaccaaggtacgtactataccgatacgaaccaacaacgaacaactacgaccaacgacgaccgtacctacgtaccgtaacgtaacgtacggtaaacgttacggaaacggggtaaccgtagaacgtacgttacgtaaccggaacgaaccggtaaccggtaccttaagttacgttagttaggtaacggtacgaaggtaacgttaacgttaaaccttaccttaccttacgttataacgacgttttaacgagtagttacgtgttaacgtttaacg

SEQ ID NO: 436119 - DNA, 695 bp, Homo sapiens
  misc_feature: GZ8MTXP01AD22D.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttagtggtgtcagtcgtgggtcgccgtacgacgggtcccccgtagggaaccgaaagggtcttaggaggtgggtaagtgggggagttagggactcgaaggtacctaaactttaacgaaagtacggaaaaacaacgtaaaaggttactacggaacctaaacgtaaagttaaaccgtttccggaaacgggtaccaaggtacgtactaagtaccgtaagtacggaaaccaacgtaacgaaccaacactaccgaacgcactacgtacacctaacgtagtacggaactacgggaacggtaacgttgaaggacttacggacgaccgaacgtaccgtacttaattagttagtcgtaagcgttaagtaacgaacttaacttcccgttacgttacagttaacttagaacgttagtaggttattcgttaactttttaacgg

SEQ ID NO: 436120 - DNA, 661 bp, Homo sapiens
  misc_feature: GZ8MTXP01AJ8RK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtgggcctcagtgaacgtctctgcaaggtcttctggttactacttttagctagttagtggtgtcgagtcgtgggtgcgacgacggtccccgtaggacgaagggtcgttggaggtgggagtgggagtggatcagactaacttaacgaagtacggaaactaacgaaagtatacgacaatattaacttacgaagggacaagtagtcgaatacgagtacgtaaccaacacgacaactactacccgaacgacgtaccacgtcgtaccctaacgagtacggaacgttagaacggggtaaacctgggactacgtaccgtacgaccgaaccgtacgtacctttaagtagtttacgttggtaacgtacgaagggtaaaccttaacgttaaactttcccgttaaccctttattaacgttaaccttaggaacgttaagtaggagtttaacgttctttttaacg

SEQ ID NO: 436121 - DNA, 564 bp, Homo sapiens
  misc_feature: GZ8MTXP01AM2S9.38.25.C03.1.454.CMB.2.raw
  modified_base (377)..(377): a, c, t, g, unknown or other
  modified_base (408)..(408): a, c, t, g, unknown or other
  modified_base (457)..(457): a, c, t, g, unknown or other
  modified_base (463)..(463): a, c, t, g, unknown or other
  modified_base (496)..(496): a, c, t, g, unknown or other
tcagtcgatcacgtcacgaccggtgctcgatttagtagtgtagatttgggtttgggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggaccaagggcttgagtggatgggatggatcagcactttaacaataggaaacacaaagtatcgacacataacttccaagggcngagtacatcaatcgaaccacacgacactacnccaagagaccactcgacctacattaggaacctggaacggggaacctganactcgngaccgacaccgggtcttaatagttaatcgtganaacggtacaactaaacttccttacccttattactaattaccgaagtatagggaattgttcttttaacg

SEQ ID NO: 436122 - DNA, 552 bp, Homo sapiens
  misc_feature: GZ8MTXP01AK015.38.25.C03.1.454.CMB.2.raw
  modified_base (396)..(396): a, c, t, g, unknown or other
  modified_base (406)..(406): a, c, t, g, unknown or other
  modified_base (437)..(437): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcaacttacaatggaaactacaaagtatcgacactataacttccgaaagggcaagagtcatcatgacacaganacatcacgancactgactacatcggaactgacgggactganatctgacacgacggtcttaagtattagttggaagcgaagaaacgacgtaaacttccttaccttacgttacttaattacggaacgtaagttcgggaaagttcgttaaccttttaag

SEQ ID NO: 436123 - DNA, 896 bp, Homo sapiens
  misc_feature: GZ8MTXP01AIBKH.38.25.C03.1.454.CMB.2.raw
tcagtcgatcacgtcacgaccggtgctcgatttagtagtgtagatttgggtttgggggacccaaaaacccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctaggttactacgtttttagctagttagtggtgttcaggtcgtggggtgcgtacgacggcccccgtggaccgaaaggggtcctttaggaggttagggtacgtgggggtaatgggggtaacttcgaacggtacctaaaccgttttaacgaaacgtttacgggaaaaacctaaccgtaaaaaaggttactaccggaacctaaacgttaaagtttaaacccgttttacccgggaaaacgggggttaccaacgggtacgtaaccctaaacttaccccgtaagttaccggaaacccaaacgtaacggaaacctaacccggaactaccccgaaacggaacggaccctaaaccgttacggaccccttaaaacggacgtttaacggggaaaccccttaggggaaaccgggggtaaaccccttaggggaaataccgtttaccggtaacgggaaccccgtaacgggtaaccccgggttaccttttaaagttagttttaaccggttaggttaaccggaacggttaaccgggtaaacgttaaacccgttaaaccgtttacccccgttaacgttttaaaccccaagttttaaacccggtttaacggaaacccggttaacggtaaggggttaacgtttaacgtttaacccttttttttaaacccgg

SEQ ID NO: 436124 - DNA, 713 bp, Homo sapiens
  misc_feature: GZ8MTXP01CAE96.38.25.C03.1.454.CMB.2.raw
  modified_base (631)..(631): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagtcgtgggtgcgacgacggccccgtaggacgaaggtcgttaggaggtggagtgggtagtgggactcgacgtacctaactttaacgaaagtacgggaaaactaacgtaaaaggttatacggtaacctaaacgtaaagtttaaaccgtttaccggaaacggggtaaccaagggtaaacttacggaacttaacgacgtacggaaaccaaacgaacgaaacctaaccaccgtttaacccgaacggtaacgacccgtaaccgttaccgaacccgtaacgtacgtaacggtaacggtaacggaacggggtaaccgtaggaacgtacgtacgtaccgacgtaccgtacgtacttatacgttntgtaagacgttagtaaacgttacgtaaacttccttaacgttacttataacgtacgaagtagtaggttatcgttcttttaacg

SEQ ID NO: 436125 - DNA, 702 bp, Homo sapiens
  misc_feature: GZ8MTXP01APNEC.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcgaaggtcttcgtggttactacttttagctagttatggtgtcagcgtgggtgcgacgacggcccctggacaaggtcttggagtggagtgggatggatcgagtcgtaactttaacgaaagttacggaaaaactaacgaaaaggttatacggacaacgtaattaaacgtttccgaaaaggggaccaaggtacgtacaattacaagtacgaaacccaacaacgtaaccaactacacccgaacggacgacctaacgtacgacccttaacgacgttaacggaaactgggaaacggggaacccttggaacgacttacgacgaaccgtaacgtaccgggtacctttaaggtaatttattggtaacgtagaacggtaacttaaaccttaaacgtttcccttaacgtttaacaaactttaagttaacccgtaacggtaagttaggggttaaactttccggttaacttttttaaccgg

SEQ ID NO: 436126 - DNA, 688 bp, Homo sapiens
  misc_feature: GZ8MTXP01EL8J3.38.25.C03.1.454.CMB.2.raw
  modified_base (378)..(378): a, c, t, g, unknown or other
  modified_base (573)..(573): a, c, t, g, unknown or other
  modified_base (629)..(629): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagcgtgcggtgaagaggccgtggggcctcgagtgaacgtctccgtgctaaggtcttcgtggttactacttttagctagttagtggtgtcagcgtgggtgcgacgacggcccgtaggaacgagggtcttgagtggagtggagtggattcgagactaacgttaagaagtaggaaaactaagaaagtanacgaccaataattaacgttccggaagggacaagggactacaacttacaacgttacgaacaacgacacaaacgacaccgacggaactaccgacgttacgacccttaagaacgttacgggaaacgttacgggaaacgggtaacgttaggaagtacgttacgaacgaacgtaaccgtacggttacttaagttacgttntgggtaacgacgttaaggtaacttaaaccgttaaacgtttccttaaccgtttaaanaccgtttaaagtacggtaacgttaagtacgggttaaatttcgtttaacgtttttaaccg

SEQ ID NO: 436127 - DNA, 718 bp, Homo sapiens
  misc_feature: GZ8MTXP01BFMNM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctggcggtgaagaggcctggggcctcgagtgaacgtctctgcaaggtcttcgtggttactacttttagctagttagtggtgtcaggtcgtgggtcgcgacgacggcccctgggacgtaagggcttggagtggagtggggagtggatacgacgtactaacgttacgaaaggtacggaaaactaacgaaaagttcgacgactaacgtaacgttaaacgtttccggaaacgggtacctaaggtaacgtcaaataccgtaagtacgaaaccaacgacgtaaaccaactaacgaccgaacgacgaactaaccgtcgtacccaaacgtacgttaaccggaacgtacggaaacggggttaaccgaggtaacgtacgttaccgacggaaaccgtaccgtaaacccggttactttaattacgtttagttcggtcgaacgttaggaaaccttaaacttaaacctttacccttaccttaacgttacttaagtaaccgggtaagtacggtaggttaacttaacgttctttttaacg

SEQ ID NO: 436128 - DNA, 739 bp, Homo sapiens
  misc_feature: GZ8MTXP01EHT19.38.25.C03.1.454.CMB.2.raw
  modified_base (591)..(591): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtacgaacgtctacctgacgaagtcttcgttggttactagttttagctagttatggtgtcgagtcggtgggtcgacggtaaccgcggtccccgtaggaacggtaacgggtctttagggaggttaggtaggtggggtagttagggtacttacgaaggtacctaactttaaacgaaagttaacggaaaaccaaagtaaaacggtctaccggaaacctaacttaaaagtttaacccgtttacccggaaaaggggaccctaagggtaaacttactaaacttacgtaaacgtaccgggaaacctaacggaaacgtaccaaactcaaaccgacggatacccgacgtacgtaccccgaagtaaacgacggtaaacncggaaacggggtaacttaggaacgtaccgttgaaccgaaccgaaccgggtaaacttacctttaattattaacggtgtaacacggataacgttaactacttaccttacttattacttaagacaagttagacggttatctttgtttaacg

SEQ ID NO: 436129 - DNA, 571 bp, Homo sapiens
  misc_feature: GZ8MTXP01AUDP6.38.25.C03.1.454.CMB.2.raw
  modified_base (350)..(350): a, c, t, g, unknown or other
  modified_base (357)..(357): a, c, t, g, unknown or other
  modified_base (500)..(500): a, c, t, g, unknown or other
  modified_base (511)..(511): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagctgggtgcgacaggcccctggacaagggcttgagtggatgggatggatcagcactacaatggaaacacaaagtntcgacanagtaattccgaagggcaagagtcatcatcgacacagacacactccaacgatcacttacgccttacaagtcggaaactcggaaggggaacctaggagactacgtcgaaaccgggacaaccggtcctttaagtacctttattggngacggaagtanaaactaaacttccttacgttacagttaactacggaactagtaggttattcttcgttttaa

SEQ ID NO: 436130 - DNA, 725 bp, Homo sapiens
  misc_feature: GZ8MTXP01BOW7M.38.25.C03.1.454.CMB.2.raw
  modified_base (206)..(206): a, c, t, g, unknown or other
  modified_base (378)..(378): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagnggccgtggggcctcgagtgaacgtctctgcgaaggtcttcgtggttactacttttagctagttatggtgtcagcgtgggtgcgtacgacggccccgtaggacgaagggtcttggaggtggagtgggatggatcgacgtctaactttaacaagtaggaaaaccaagtaaagtntacgactaactaattaacgttcccgaaagggtaacaaggtactacaacttacaatacggaaaccaacaacgaacacctaacgacccgaacggacaacctacgtacgtacctaacgaagtacggaaacgtacggtaaacgggggtaaaccttaggggaactacgttacgaacccggaacgtaaccgtaaccggtttaccttaaagttacgtttagttcgggtaacgtaacggaaacggtaaacgttaaaccgtaaaacgttttcccccttaacttaaacggttactttaaacccgggtaaccgtaaggttaacgtagggttaagttaaccgtttaacttttttaaccg

SEQ ID NO: 436131 - DNA, 776 bp, Homo sapiens
  misc_feature: GZ8MTXP01BCUHE.38.25.C03.1.454.CMB.2.raw
  modified_base (335)..(335): a, c, t, g, unknown or other
  modified_base (358)..(358): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaagaggccgtggggcctcgagtgaacgtctcctgacaaggtcttcgtggttactacttttagctagttatggtgtcagcgtgggtcgcgacacggcccctaggacgaaggtcttgagtggagtgggatggatnagctacgtaacagtaggaaacanaaagtatacgacatataattccgaagggacaagtagtacaatacagtcgaaacaacgagaacaactacgaccaaacggacaaccacgttacgaccccttaaagaacgtaacgggaaaacgttacgggaaacgggggtaaaaccctttggggaaacaccggtttaacaaccggggaaaccctaaccggttaaacccgggttacccttttaaagttaaacggttttagttcgggtttaaacccggaaaggttaaacgggggttaaaaccttaaaccgttttaaaaaacccgttttaccccgtttaaaccccgttttaaaagttaaaccttttaaaacggttttaaacccgggaaacggtttaaaagggtagggggttaaaaacccttttgggttttaaacccgttttttttaaacccggg

SEQ ID NO: 436132 - DNA, 864 bp, Homo sapiens
  misc_feature: GZ8MTXP01B6NUJ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcgagtgaacgttctcctgcgtaaggtcttcgtggttactacttttagctagttagtggtgtcgaggtcgtggggtcgacgtacgacggccccgtggaacgtaaggggtccttagggaggttcgggaaggtggggtaatgggtaactccgacgggtaccctaaacgtttaaacgaacgttaacggggaaaaaccctaagtaaaacggttacgttaccggaaacctaaacgttaaacgttaaacggttttaccccggaaaagggggtaccgtaaggggtaacgttacctaaacgggttacctaaacgtaaccgaaacccgaaaccaacggttaaacccgaaaccttacgtaaccccggtaaacggaccgaacctacccgtacggtaacccctaaagttaccgaaacggggtaacgttaacgggaacggggttaaaacccggtaggtaaacggtaacgttaccggtaccgtaaaccggaaccggttaacgtttaccctttaaagttacccgttttaggtcggttaacggacgttaaacgggtaaccttaaactttaaacccgtttccttaaccctttaaagttaacgtttaacgtaaccgggttaacgtaaggttacgggttacgtttcgttttaaacggtttttcg

SEQ ID NO: 436133 - DNA, 692 bp, Homo sapiens
  misc_feature: GZ8MTXP01DBWAF.38.25.C03.1.454.CMB.2.raw
  modified_base (359)..(359): a, c, t, g, unknown or other
  modified_base (476)..(476): a, c, t, g, unknown or other
  modified_base (507)..(507): a, c, t, g, unknown or other
tcagtcgatcacgtcacgaccggtgctcgatttagtagtgtagatttgggtttggggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatccaactgacaagtccagccagtagttcgttttacacgtaggtacccaaacaaattaaagtaacttacttcgacttacggtaaccagacaaacgaaaccgaggaaccacggtaccctacctaaaggttcgactactaattttacgngggactacgttccggtacccggggtaggttcccggggtccctaggacccgtacttccggacggcggacgacggtccgggttactggacgacgagtactttccaacttctaccactanacacgctacgccgtagacgacgctagaaagngttggacggtacttaaggtttacttaacgtcgtatacggtacttaaaggttaattactaaacgggttctacccgttaacgtaacgggtttcggttaaccgggggtacccggggaaactaaccgggtacgttaaggggacttaaacgtaacgaaaacgtgttcggacggttctaaccggctaaccg

SEQ ID NO: 436134 - DNA, 628 bp, Homo sapiens
  misc_feature: GZ8MTXP01AOHZX.38.25.C03.1.454.CMB.2.raw
  modified_base (432)..(432): a, c, t, g, unknown or other
  modified_base (488)..(488): a, c, t, g, unknown or other
  modified_base (544)..(544): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggcctggggcctcagtgaacgtctcctgcaaggctttctggttactacttttagctagttatggtgtcagtcgtgggtgcgacgacggccctggacgaagggcttgaggtggagtgggagtaggatcgagctaactttaacgaagtaggaaacaacgaaagtatacgacatattaacttcgaaagggtcaaggatacatacagtacgaaccacaacgacacgtacnccgaacgacgacaactcgaccctaacagttacggacgtaggaacggggactagganactccgaggacctacgtaccgtacttagttaattcgttggtaacgagaacggtaanaaacccttaaactttcccttaccttaattaacgttaacgttaacggaacggtaacgtgggttaagttcgttaacgtttttaacg

SEQ ID NO: 436135 - DNA, 639 bp, Homo sapiens
  misc_feature: GZ8MTXP01DBHJ7.38.25.C03.1.454.CMB.2.raw
  modified_base (293)..(293): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaagaggccgtggggcctcagtgaacgtctcctgcaaggtcttctggttactactttttagctagttatggtgtcaggcgtgggtgcggacncggcccctaggacgaagggtcttgaggtggagtgggatggatcagctaacttaacaataggaaacaacaaagtatcgacactaattaaacttccgaaagggactaaggtagtaccaagtactatacgaaccaaacgaacgaacaacgactaccgaacgagaccactcgacctaacagtacgaaactggaacggggaaacctggaactacgtcgtaacggaccgacgtaaccggtactttattaagttacttggtaacgagaacgtacgttaaacttaaaaccttccttaaccttacgttaacttaactaacgaacgttagtagggttattcgttaactttttaacg

SEQ ID NO: 436136 - DNA, 677 bp, Homo sapiens
  misc_feature: GZ8MTXP01CY17P.38.25.C03.1.454.CMB.2.raw
  modified_base (416)..(416): a, c, t, g, unknown or other
  modified_base (443)..(443): a, c, t, g, unknown or other
  modified_base (450)..(450): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattcctttttcttggtggcagcagcaacaggtgcccactcccaggttcaattggtgcagtctggagcgtggcgggtagaaggaggccgtggggcctcgagtgaacgtctcctgacaaggtctttctggttactacgttttagctagttagtggtgtcaggtcgtggggtgacgacgacgggccctagggacgaagggcttggaggtggagtgggatggatcgagctaactttaacaagtaggaaaacacgaaagtatacgacaactattaaacttccgaaagggacngagtacaatacgaatcgaaccacgaanacctaanactacgaacggacactacctgaccctaagagtacgaaactaggaacggtaaccgtggaaactcgtacgtaaggaccgtacgtaaccggttacttaagttattacgttgtaacggtacgaaagtaacgttaaaccttaaacgtttcccttaaccgttaattaacgtttaaacgttaaccggtaacgtgggttaaacggttagtttaaccggtttaacgttttttaacg

SEQ ID NO: 436137 - DNA, 603 bp, Homo sapiens
  misc_feature: GZ8MTXP01DI6M1.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctaggacgaagggcttggaggtggagtgggatggatcgagctaactttaacgaagtaggaaacaacaaagtatacgacactattaaacgttcccgaaaggggcaaggtagtacattcaatacgaaccaacacgacacactccaacgacgacactcgacctacgagtaggaactggaacgggacctgaacgtactacgacgacgacgaccggtcttaatattagtgtaacgtacgaggtaacaacttaaacttccttacttacaattaactaacgaacgttagaggttaagttcgttaacgttttaacg

SEQ ID NO: 436138 - DNA, 645 bp, Homo sapiens
  misc_feature: GZ8MTXP01ACSPZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctctgcaaggtcttctggttactacttttagctagttatggtgtcaggctggggtgcgacgcggcccctggacgaagggcttggagtggatggggactggatcagctactttaacaaataggaaaacaagtaaagtatacgacctaataagttaaacttccgaaggggaccaagtacgtaccatacagacgaaacaacacgaacacaacgtaccgaacgagacctacgtcaccctagagtaggtaacgaggaacgggaacgtaggtagaacttcgtacggaaccgtaaccgtacccggtactttaacgttacgttaagttcggaacgacgttaaagtaacgaaaccttaaacttccttaccgtttaaacagtttaactacgggaactagtacggttaagtccgttaactttttaag

SEQ ID NO: 436139 - DNA, 686 bp, Homo sapiens
  misc_feature: GZ8MTXP01BQX1D.38.25.C03.1.454.CMB.2.raw
  modified_base (373)..(373): a, c, t, g, unknown or other
  modified_base (397)..(397): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtagaaggaggccgtggggcctcgagtgaacgtctcctgcaaggtcttcgtggttactacttttagctagttagtggtgtcgaggtcgtgggtcgcggtacacggccccgtagggacgtaaggggtcttaggaggtgggaggtggggagtgggatacgaggtactaaccgttaanaaagtaggaaaacacgtaaaagtntacgacctaatagttaaacgtttccgaaagggtcaagtacgtacatactagtaccgaccaacgacgactaacactaccgaacgagtacccacgtacgacctagacgtacggaactagggaacggtaaccgtagacgtacgtcgtaacggaccgacgtacggtaccttagttactttagtggtaacgacggttaagtaacgttaacttaacctttccttaacccttagttaactttaacgtaacggtaacgttaacgtaggggttaactttcgtttaacgtttttaacgg

SEQ ID NO: 436140 - DNA, 679 bp, Homo sapiens
  misc_feature: GZ8MTXP01B21VN.38.25.C03.1.454.CMB.2.raw
  modified_base (360)..(360): a, c, t, g, unknown or other
  modified_base (384)..(384): a, c, t, g, unknown or other
  modified_base (445)..(445): a, c, t, g, unknown or other
  modified_base (452)..(452): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcgagtgaccgtctcctgcaaggtcttcgtggttactacttttgctaggttatggtgtcaggtcgtggggtgccgacgacggccccgtggacgaagggtcttaggaggtggagtgggatgggatcgagtctaacgttaanaagtacggaaacaaacgtaaagtntacgactaactaattaacgttccgaaagggctaaggacgtacaagtacactacggaaccanaacgtanaaccgtacaccgaacggacacctacgtacaccttaagatacgggaactacggaacggggtaacgtaggacgtaagtcggtaacgacgtacgtaccggttacctttaattagttacgtggtaacgaacggggttaaactaacgttaaacttaaaccttccctttacgttaacttacgttaactaacgggtaacgttaaggtagttacgtttaacgttccttttttaag

SEQ ID NO: 436141 - DNA, 740 bp, Homo sapiens
  misc_feature: GZ8MTXP01EH06H.38.25.C03.1.454.CMB.2.raw
  modified_base (287)..(287): a, c, t, g, unknown or other
  modified_base (362)..(362): a, c, t, g, unknown or other
  modified_base (462)..(462): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacncggccctggacaggtcttgagtggagtgggatgggatcgagtcaactttaacaagtaggaaaccaagaaaagtanacgacaagtaattaacgtttaccgaaaggggtacaagagttaccaatcatacgacaacacgtacacactacccaacgacgacaaccgtcgtacccctaanacgtacggtaaacgtcggaaacggggtaaccttaggacgtaacgttccgtacgaacccggtaactaaacccgggttacctttaagttaaagttttaaccggttgggttaacggtaacggaaacgggtaaacgttaaacccgtaaaaccgtttttccccttaaacccgtttaaacccgttaatttttaaaaccggttaaaaccgggtaacccggtttaaaaggttaaccgggggttaaaagtttaaccggggtttttaaccgttttttttaaacccggg

SEQ ID NO: 436142 - DNA, 716 bp, Homo sapiens
  misc_feature: GZ8MTXP01AV4JV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcagtgaacgtctcctgcaaggtcttcgtggttactacttttagctagttactggtgtcgagtcgtgggtgcgtacgacggtccccgtaggaacgtaagggtcttaggaggtaggagtggggagtcggacttcgaaggtacctaaactttaacgaaagtaacgggaaaactaacgaaaagtactacgactaaacgtaattaaaccgttcggaaacgggtacaaggtactaacacttacgaataccgaaacaacgacaacaacacgtaccaaggacacctactacggaccctagaacgtaacggtaacgtaacggaacggggtaaaccgttagggaaatacgttaccggtaaccgaaccggaaccgtaacggttacctttaaagttacgtttagtaccgtaagggaaaccgaagtaacgttaaaccgttaacttacccttacttaaccgttattaacgttacgaacgtagtagggttacttaacgttaatttttaaccg

SEQ ID NO: 436143 - DNA, 713 bp, Homo sapiens
  misc_feature: GZ8MTXP01CD6CK.38.25.C03.1.454.CMB.2.raw
  modified_base (537)..(537): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgacgaaggtcttcgtggttactacgttttagctagttagtggtgtcaggtcgtgggtcgcggtacgacggtccccgtaggaacgtaagggtcttaggaggtggagtgggatgggaactcgaggactaacgtttaacgaagtaacggaaactaacgtaaagtagtaccggacaactaagtttaaacgttccggaaaacggggtaccaagggtacgttaccgaaacttcgaaacgtaccggaaaccaaacgaacgaacccaactacgtacccgaacggaacgaccctaacgtcgtacccgttaanacggttaacggaacttagggaaccgggtaaccgtagaacgacttacgaccgaaccgtacgtacccgttatttacttagtttcgttggaacgcgaaaggtacaaacgtttaaccttcccgttaacttaacttagttaactaccggaattaggtacggttattcgttctttttaacgg

SEQ ID NO: 436144 - DNA, 782 bp, Homo sapiens
  misc_feature: GZ8MTXP01B1924.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttcgttggttactacttttagctagtttagtggtgtcaggtcgtgggtgccggacgacgggtccccgtaggacgagggtcttaggaggtggagtggggagtgggatacgaggacctaacgtttaacaaagttacgggaaaacaacgtaaaagtacgtaccggaactaaactaagtttaaaccgtttcccgaaacggggtcaacggtacggtacctacgtacgtactacggaaacccaaccgaacgaaaccctaacgtaactaccgaacggacgtaccctacggttccgaacccgttaacgaacgttacgggaaaaccgttacgggaaccgggggtaaacttaggggaaacaaccgttacgtaaccgggaaccgtaaccggtaaccccggttactttttaaagttagttttaaacgttcgggtaacggtaacggttaacgggtaaacttaaccggttaaaaccttttccccttaacccgttaattacctttaaagtacggtaacgttagtagggttacttcgtttttaactttttaaaccg

SEQ ID NO: 436145 - DNA, 698 bp, Homo sapiens
  misc_feature: GZ8MTXP01DW2G7.38.25.C03.1.454.CMB.2.raw
  modified_base (474)..(474): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagtcgtgggtgcgacgacggcccctaggaacgaagggtcttaggaggtggagtgggagtggatcgagtctaacgtttaacgaagtaggaaaccaacgaaagtacgtcgacaacgtaattaacgtttccgaaaaggggactaaggtacgtacaatacaacgtacgaaaccaaacaacgaaccaactactaccgaaccgganacctaacgtccgtacctaaacacgtacggaaacgttacggaacgggggtaaccttagggaaccgtacgttacgtacggaaccgaacggtaaccgttaacctttaagttaactttagtggtaaccgacgaaggtaaaccttaacgttaaactttcccttaaccgttaattaacgttaacgttaacgaacgttaggtcggttaaagtttcgttaacttttttaacg

SEQ ID NO: 436146 - DNA, 672 bp, Homo sapiens
  misc_feature: GZ8MTXP01B8QY3.38.25.C03.1.454.CMB.2.raw
  modified_base (588)..(588): a, c, t, g, unknown or other
  modified_base (629)..(629): a, c, t, g, unknown or other
  modified_base (643)..(643): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaaggaggccgtggggcctcgagtgacgtctctgcaggtcttcgtgttactactttagctagttagtggtgtcgagtcgtgggtgcgacgcggcccctaggacgtagggcttaggagtggagtgggatgggactcgaggtacctaactttaaacgaagtaacggaaacaaacgaaagtactacggactaaactaacgtttaaactttacccggaaagggtacaagggtactaccgtaataccgaagtaccggaaaccaacgaacgaacacgtacaccgagacgtacctactacgtaccgaactagtacggaaaccgtgggaaacggggtaaccgtaggaagtacgacgtaacggaccgaacgtaccggttacttaagtatttaacgnggtaagacgttaagacgttaaacttaacttccttaccttanacttaacggtaacngtaagtggttacttgtttcttttaaccgg

SEQ ID NO: 436147 - DNA, 723 bp, Homo sapiens
  misc_feature: GZ8MTXP01AELSO.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcgagtcgtgggtgcgtacgacggtccccctagggaccaaagggtctttggaggtggagtggggatgggattcgaggtctaacgtttaacgaaagttacggaaaaacctacgtaaaaaggtcctacggaacctaactaaagtttaaaactttcccggaaaaggggtacctaaggacgtttaccaaagtacgtaaactcggaaacccaagaacgacaacgactacccgaacgagaccctaacgtcgacccttaacgagtacggaacgttaggacgggtaaacctggaagtactcgtacgaccgtactaccggtcctttaattaacgttcgttaggtgaacggttaaggtaaacttaaaccgttaaaccttccctttaaccgttaacgttaactttaaccgttacgaaccggttaagtaagggttacgttaacggtttaactttttaacccg

SEQ ID NO: 436148 - DNA, 610 bp, Homo sapiens
  misc_feature: GZ8MTXP01B98SI.38.25.C03.1.454.CMB.2.raw
  modified_base (366)..(366): a, c, t, g, unknown or other
  modified_base (578)..(578): a, c, t, g, unknown or other
  modified_base (603)..(603): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttcgtggttactacttttagctagttatggtgtcagtcgtgggtgcgacgacggccccgtaggacgaagggtcgttaggaggtggagtgggatggatcgagctaactttaacaagtaggaaaacanaaagtatcgactaactaattaacgttacaaaggtacaagtacgtacatcatacgaacaacgagaaccacactaccgacgacgacctacgtcgtacctaaacgagttaacggaacgttacggaacggggtaaccttaggaagtacgtacgacgaccgaacgtaccggtacttagttattagtgtaagagttagaacactaactccttacttanataactagaacgtagtgttatgttntttaacg

SEQ ID NO: 436149 - DNA, 834 bp, Homo sapiens
  misc_feature: GZ8MTXP01E1XDG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctctgcgtaaggtcttcgtaggttactactttagctagttatggtgtcagcgtgggtgcgacgacggccctaggacgaggctggaggtggagtgggatgggactcgagtaccgtaactttaacgaaaggtaacggaaaactaaacgtaaaaggtataaccggtacctaaagtaaacgtttaaactttcccgggaaaaggggtaccaaggtacgtaacgtaactaccgaataccggaaacccaacgaaacgaacctaaacacgacccgaaacggacacccgtaaccgtaccgtaccctaaagtacggtttaaaccggaaaccggtagggtaaaaccgggggtaaacccggtagttaaaacggtaccgtttaccggtaaccgggaaaccccgggttaaccgtaaaccccggggtttacttttaaaagttttacccggtttaagggttaacgggttcccgggaaaaggttaaacgggaacgtttaaaacccgttaaaaccgtttttccccgttaacccgtttaaattaaacccggtttaaaggttaccccggtaaaggttaagggttaccggggaaatttttcccgggttttaattttttaaccccgg

SEQ ID NO: 436150 - DNA, 642 bp, Homo sapiens
  misc_feature: GZ8MTXP01CHTGF.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctctgcaaggcttctggttactacttttagctagttatggtgtcagcgtgggtgcgacgacggccccgtggacgaagggcgttggaggtggagtgggatggatcgagctacttaacaagtaggaaacaacgtaaagtatacgactactaattaacttccgaaagggtcaagacgtacatacgatacgaaccaaacgacgaccaacactaccgaacgtacgcctacgtcgacctaacagtacggaacgtaggaacggggtaccgtaggacgtacgtaccgtacggaaccgtaacgaccggttaccttaattacgtttagtggtaaccgtaggttaacgaacgttaaacttaaacttcccgttacttacttacgttaactacgtaacgtagtaggttacttcgttctttttaacg

SEQ ID NO: 436151 - DNA, 746 bp, Homo sapiens
  misc_feature: GZ8MTXP01DUA75.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggtcttcgtggttactacttttagctagttatggtgtcagcgtggtgcgacaggcccctaggaacaggcttgagtggagtggatggatcgagtacactttaacaagtaggaaaacaaagtaaaagtatacgactaaacgtaatttaaacgtttcccgaaaggggacaaggggaaacgtttacaattaccgaagttacggaaaccaaacgaacgaaaccaacctaacggtacccaacggaaagaccctaacgttaccgaccccttaaacgacgttaaggaaccgttagggaacgggtaaaccgttggaaagtacctagtaccggaaacgtaacgtaccggttaaccttaattaaacgttagttgggtaaccgaaggttaaacggaaacgttaaacccgttaaaaacgtttcccccgtttaaaccgttaaaccttaaatttaaaccccggtttaagaaccgtttaaacgggtacgggttaaggtttaaccgtttaacgttttttaaaccg

SEQ ID NO: 436152 - DNA, 642 bp, Homo sapiens
  misc_feature: GZ8MTXP01BAWXW.38.25.C03.1.454.CMB.2.raw
  modified_base (576)..(576): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtacgacaggcccctggacaagggcttggagtggatggggatggatgagcacttacaataggaaaacacaaagtatagacccaactaattaaacgtttcccgaagggggtaccaaggaacgttacaaactacaatacggaacccaacaaacgaacaacaactacccgaacgaacgacctaaaccgtcgaacccttaacgaacgttacgggaaaccttaggtaaacgggaaaccctaggaacggtaactacgtagaaccgaacgacggttaccttataatttaattgtgaacgtaagganaacttaaattccctacttaacgattaacgttaacgagtaagtaggtattgttctttaattttaacg

SEQ ID NO: 436153 - DNA, 678 bp, Homo sapiens
  misc_feature: GZ8MTXP01A0RN2.38.25.C03.1.454.CMB.2.raw
  modified_base (621)..(621): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggtcttcgtggttactacttttagctagttatggtgtcaggctgggtgcgacacggcccctggacgaaggtcttgaggtggatggatgatcgagcacttaacaagtaggaaacaacgaaagtatcgacaacgtattaactttaccgaagggtaccgaagtacgtccaattacagtacgaaaccaacacgaacaccaactacccaacgaagaccctaacgtacggtaccttaaaccaagtaaccggtaaaccgtacgggaaccggggtaaacccgttggtaacgtacgttaccgaacggtaaccggaaccgtaaccggttaccttaaggttacttagttaggtcgacgttaaggacttaaacgtaaactttccccttaaccgttaanaacgttaacgttaacgtaaccgtaggttaggaaacgtttcgttaacgtttttaaccg

SEQ ID NO: 436154 - DNA, 666 bp, Homo sapiens
  misc_feature: GZ8MTXP01DQ17D.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactacttttagctagttatggtgtcaggcgtgggtcgcgacgacggccccgtaggacgaagggtcgttggagtggagtgggattggatcgagtactaactttaacaagttaggaaaacaacgaaaagttactcgacaaacaactttaaacgttaccgaaaaggggactaaggaacgttacaacgtacaacgtacgaaaccaacagaactaacaacgtaccaacgagtaccactacgccctaaagagtaggaaactaggaaacggggtaacctaaggagtaacgtacgtaccggaacgacgtaaccggtactttaatagtttacgtagtaaggagaaagtacgttaaactaaacttccttacgttattaagttaacgttaacgaacgtaagtaggttaatcgtttaacgtttttaacg

SEQ ID NO: 436155 - DNA, 685 bp, Homo sapiens
  misc_feature: GZ8MTXP01AO2PX.38.25.C03.1.454.CMB.2.raw
  modified_base (398)..(398): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcgtggggcctcgagtgaacgtctcctgcgaaggtcttcgtggttactagttttagctagttagtggtgttcaggtcgtgggtcgcgacgtacgggcccctagggaaccgaagggtcttggaaggtggagtgggtatggtaactgacggtactaacgtttaacgaaagttacggaaaaccaacgtaaaagtntaccgacagtaacttaacgtttaccgaaaggggacaagggtaactctaatacaagtcgaaacccaagaacgaacctaacgacaccgaacgacgtaacccaacgtccgtaccttaacgtagaacgggtaactaacgggaaacggacttaggacgtacgttacgacgaccgtaacgtacggttacttaagttattagtcgtaagacggttaaacgtacttaaacctaacttacccttacttacttactaaccgtagaacgtagtagggttagttaatttcgttttaacg

SEQ ID NO: 436156 - DNA, 586 bp, Homo sapiens
  misc_feature: GZ8MTXP01AZQ0J.38.25.C03.1.454.CMB.2.raw
  modified_base (404)..(404): a, c, t, g, unknown or other
  modified_base (406)..(406): a, c, t, g, unknown or other
  modified_base (412)..(412): a, c, t, g, unknown or other
  modified_base (418)..(418): a, c, t, g, unknown or other
  modified_base (423)..(423): a, c, t, g, unknown or other
tcagtcgatcacgtcacgaccggtgctcgatttagtagtgtagatttgggtttgggggacccaaaaaccacacccctccttgggagaatcccctagatcacagctcctcaccatgggactggacctggagcatccttttcttggtggcagcagcaacaggtgcccactcccaggttcaattggtgcagtctggagctgcggtgaagaggcctggggcctcagtgaacgtctcctgcaaaggcttctggttaacactttttagctagttatggtgtcagctgggtgcgacaggcccctggacaagggcttgagtggatggatggaatcaagcatttacaatggaaaacacaaaagtataggcaacgaataaacttccaaagggcaagatcaaatccatgaccaananacacanacacanacacncgacacacgtagaacgtagaacggggaacgacgagacgtacgacgacgaacgaacgaccgttaattaacttacttgtaacgtacgaagaagaaacgtaaactaaccttacccttacttaactaactaacgtaacgtaacgtaggaagtaacgttaacgttaag

SEQ ID NO: 436157 - DNA, 675 bp, Homo sapiens
  misc_feature: GZ8MTXP01CTJRN.38.25.C03.1.454.CMB.2.raw
  modified_base (434)..(434): a, c, t, g, unknown or other
  modified_base (477)..(477): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttcgtggttactacttttagctagttatggtgtcagtcgtgggtgcgacgacggccccgtaggaccgtaaagggcttggaggtggagtgggatggatcagcctaacgtttaacaagtaggaaaacataaagtagtcgacaaatattaactttccgaaagggacaagactacgaatacaagtcgaaacccaanaacgaccaacactaccgaacggacgtacacgtacgaccctaanacgttaacggaacgtaggaacgggtaaacccgtggtaacgtacgttaccgtacggaaaccgtaccgtaaaccggttcctttaaagttacgttaagtttcgggaacgaacgttaaggtaacttaaaccgttaaactttcccttaaacttacttaactttaagtacccgtaagtagtacggttaggtgttctttttaacg

SEQ ID NO: 436158 - DNA, 841 bp, Homo sapiens
  misc_feature: GZ8MTXP01DJ5FO.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagtcgtgggtgcgtacgacggtccccgtaggacgaagggtcttaggaggtggagtgggagtggacttacacggactaacgtttaaacaacgtaacggaaaacgaaactaaaagtactacggaaccactaaacgttaaactttaccggaaaggggtacctaaggtaacgttacaaacgttacgaacgtacgaacccgtaaactaacgaacccaaactaccgtaccgaacgaacggaccctacgttaccaacccgtaactaacggtaacgggtaaaccgttagggaaaccggggtaaacccgttagggaacgttaacgtaccgtacggaaccccggtaaaccggtaaaccggtttccctttaaaagttttacgtttaaacgtttcggggtaaaggtaacccgggttaaaggtaaaccggttaaaaccccgttttaaaaccttttcccccggtttaaaacccgtttaccgttaaaaacgtttaaacccggttaaaacgggttaaaccgggttaaaccgttaacgggggtttaaacggttttccggtttaaaccccgtttttttttaacgg

SEQ ID NO: 436159 - DNA, 646 bp, Homo sapiens
  misc_feature: GZ8MTXP01A2WCG.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggcttctggttacacttttagctagttatggtgtcagctgggtgcgacacggcccctggacaagggctggagtggagtgggatggatcgagctaacttaacaaagtaggaaaacaacgaaaagtactgactaacaagttaaatttcccgaaaaggggtaccaagtagtaccaatacaatcggaaacccaacgacaaacaccaactaccgaacgacgacaaccgtgaccctaagagtaacgacgttaggacggggaaccttggaactagttacgacgaccgactaacggtaccttaagtatttagtgttcgacgttagacgttaacgtaaactttcccttaccgtttaacaacttaaggtttaaccgaacggttaagtacgggttaagttcggttaacttttttaaccg

SEQ ID NO: 436160 - DNA, 718 bp, Homo sapiens
  misc_feature: GZ8MTXP01AOGLA.38.25.C03.1.454.CMB.2.raw
  modified_base (453)..(453): a, c, t, g, unknown or other
  modified_base (474)..(474): a, c, t, g, unknown or other
  modified_base (490)..(490): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactaccaggttcaattggtgcagtctggagctgcggtgaagaggcctggggcctcagtgaacgtctctgcaaggtcttcgtggttactacttttagctagttatggtgtcagtcgtgggtgcgtacgacggccccgtagggaacgtaagggtcttggaggtggtaggtgggaatggactcgaggtaccaacgtttaacaagtaggaaaacaacgtaaaagtctacggacaactaagttaaacgttccggaaagggaccaaggtagtaccaagttcaagtacgaaccaanacgacaacacgtaccacgganactactcggaccctanacgtaggaacgtacggaacggaaccgttgaacgtacgtaccgtacggaaacccgtacgtaacccggttacttaagtttaaagtttaggttcggaaaccggtaggttaaaccggtaaacgttaaaccccgttaaacgttttaccccttaaccttttaacggttaacttaacggttacccggaaaggttagttaacgggttaacgtttaacgtttcgttttttaaacccg

SEQ ID NO: 436161 - DNA, 719 bp, Homo sapiens
  misc_feature: GZ8MTXP01CGTKD.38.25.C03.1.454.CMB.2.raw
  modified_base (411)..(411): a, c, t, g, unknown or other
tcagtcgatcacgtcacgaccggtgctcgatttagtagtgtagatttgggtttggggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttacgtttacacaggtaccaaactaataaagtaacttactacgcgtaggtaccagacaacgaaaccgagactacgcctactaagtcgctctaatttacgtcgggtctacgtaccggtacccggggaggtcccgggtcctacggaccgacttcggaggtccggacgacggtccgggtntcggacgtactaaggtctttaccgactcgtacccaacctactccaacgtccacgtccgtacgccgaagggtcctaaggaaacgtagttagggtacgtacggtttaacggttttaatttaccgtacggttacctaagtcgttaaagttattaagttacgttacggttcctacggtaacggttaccgggttttccgggggaacccgggggttaaaccgtaaacgggttccggaagggttaaccgttaaacggtaacccgtaaacgggtaacgttcggggtacggttccgtaaccgttaaccggttaaccc

SEQ ID NO: 436162 - DNA, 642 bp, Homo sapiens
  misc_feature: GZ8MTXP01EXXQJ.38.25.C03.1.454.CMB.2.raw
  modified_base (378)..(378): a, c, t, g, unknown or other
  modified_base (528)..(528): a, c, t, g, unknown or other
  modified_base (544)..(544): a, c, t, g, unknown or other
  modified_base (607)..(607): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtcgcccactcccaggttcaattggtgcagtctggagctggcggtgaggaggcgtgggctcgagtgacgtctcctgcgaaggtcttcgtgttactacttttagctagttatggtgtcgagcgtgggtcgcgacgcggccctaggacgaagggtcttaggaggtaggacgtgggattggatcaggctaaacgttaacaagtaacggaaactaacgaaagtntacggcctaaagaattaacgttcccgaaggggaccaagtacgtacaactactacgtaaccggaactaaacaacgtaaccaacggtaacacccgagtacgaacctacgtcgaccttagacgtaggaaacctaggacggaaaccgtgtacgntacggacacgtaaccngtcttagttctatggcgtaagagacttacgaaaccttttccgaatttacagtaacgtaaacgngtagtagggttaacttcgttttaacgttttaaccg

SEQ ID NO: 436163 - DNA, 686 bp, Homo sapiens
  misc_feature: GZ8MTXP01A7JUN.38.25.C03.1.454.CMB.2.raw
  modified_base (234)..(234): a, c, t, g, unknown or other
  modified_base (316)..(316): a, c, t, g, unknown or other
  modified_base (346)..(346): a, c, t, g, unknown or other
  modified_base (470)..(470): a, c, t, g, unknown or other
  modified_base (628)..(628): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggccgtggggcctcagtgaacgtctccngcaaggcttctggttactacttttagctagttatggtgtcagcgtggtgcgacgacgccccgtaggacgaagggtcttaggnggtggagtgggatggatcgaggcaacttanaagtagaaacgacaaaaggtactgactaataagtttaacttccgaaaagggtaccaagacgtcaattacaacgtcggaaaccaacaacgtaacaactactaaccccgaagacgacctaaccgtnaacccttaaccgaagttaacggacgtaaccgggaaggggtaaaccctagggacgaacttcgtaacggtaccgaaccgtaccggttaaaccttagttaacgtttcgttagggaagtaaccggaaggtaaacaaaccgttaaacttccttaaacccttanaaatttaaccgaactaacggtaagtgggttaaaccgtttgttaacgttttttaaccgg

SEQ ID NO: 436164 - DNA, 636 bp, Homo sapiens
  misc_feature: GZ8MTXP01DS924.38.25.C03.1.454.CMB.2.raw
  modified_base (370)..(370): a, c, t, g, unknown or other
  modified_base (399)..(399): a, c, t, g, unknown or other
  modified_base (440)..(440): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaaccgtctcctgcaaggtcttcgtggttactacttttagctagttatggtgtcaggcgtgggtgcgacgacggcccctaggacgaaggtcttaggagtggagtggatggatcgagctaacgtaacaagtaggaaacagaaagtntacgacatataacttcgaaagggcaaggntactaatactaagcaacacacgacaactacaccgaacgtanacctacacgtacctaactacgaacggaacgtacggaaaggaacccgtaggaactacctcgaacgacgaaccgtaccggtactttagttattgtcgtaaggacgacggtaaacgttaacttaaaccgtttccttaccgttaaattacgttaacgtaacgtaaggtaagtagggttacttaacgtttctttttaaccg

SEQ ID NO: 436165 - DNA, 624 bp, Homo sapiens
  misc_feature: GZ8MTXP01CQXJL.38.25.C03.1.454.CMB.2.raw
  modified_base (244)..(244): a, c, t, g, unknown or other
  modified_base (347)..(347): a, c, t, g, unknown or other
  modified_base (416)..(416): a, c, t, g, unknown or other
  modified_base (420)..(420): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtccttntggttactacttttagctagttagtggtgtcgagcgtgggtgcgacgacggcccctggaacgaggcttaggagtggagtggatggatacgagtacactttaanaagtacggaaaacaagtaaacgtatacggactaactaagttaacgttaccgaagggtccaaggtactanactntaagtacgaaccaacagaccaacactaccaacgacgaccactcgacctaacgacgtagaacgtacggaggtacctaggatactagaccgacgacgtaccgtacttacgtagtttgtcgtgtaacggagtaacgaaacttaaaccttcttaacccttagttacttaacgtacgtaacgtacgttaggagttcgttctttttaacg

SEQ ID NO: 436166 - DNA, 596 bp, Homo sapiens
  misc_feature: GZ8MTXP01CK43C.38.25.C03.1.454.CMB.2.raw
  modified_base (206)..(206): a, c, t, g, unknown or other
  modified_base (388)..(388): a, c, t, g, unknown or other
  modified_base (449)..(449): a, c, t, g, unknown or other
  modified_base (454)..(454): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagnggcctggggcctcgagtgaacgtctctgcaaggcttctggttacacttttagctagttatcgggtgtctaggcgtgggtacgcgacacgggtccccctggaacgaaggggcctttggaaggttggagttggggattgggatcgagctactttacaagtaggaaacacgtaaagtatcgacanattaagttccgaaaggggctaagacgtacattcagtcgacactagactacatccgagaacncacgnaccactacgtagaacgtacgacgggtaactacgatatcgacgacgacgtacgtacttatagtcgtggaacgagacgtaacttacgtaacttcttaacttcgacttaacgtacgaacgtagtaggttacttcgttcgttttaa

SEQ ID NO: 436167 - DNA, 753 bp, Homo sapiens
  misc_feature: GZ8MTXP01DTGE6.38.25.C03.1.454.CMB.2.raw
  modified_base (386)..(386): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttcgtggttactactttttagctagttagtggtgtcagtcgtgggtgcgacgacggccccgtaggaacgaagggtcgttggaggtggaagtgggatggatcgagtactaactttaacgaaagttacggaaaacaacgaaaagtntaccgactaacgtaagttaactttccgaaagggacaaggagtacaaatacaatacggaaccaacgaacgaacaacacgtaccgaacgaacgacctacctacgaccttaacgaagtaacggaaacgttacggaacggggtaaaccgttaggaaacgtacgttacgaacgtaaaccggtaaccgtaacccggttactttaattaacgtttaagttgggtaacgtaacggttaaaggtaaacgttaaaaccgttaaaaccttttccccgttaaacccgtttaaattaaaccgtttaaacggttaaacccggtaaacggtttaacggttaagggttaaaccggtttaacgtttaaccgtttttttaaccgg

SEQ ID NO: 436168 - DNA, 631 bp, Homo sapiens
  misc_feature: GZ8MTXP01BZVQZ.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggccccgtaggaccgaagggtcgttaggacggtggagtggggatggatcgagctaacttacaagtggaaacagaaagtatcgacataattaattcccgaaagggtacaaggtagtcagtacactacgaaccacgagaaccacactacccgacggacaccacttcgacctacagtacggaaacgtcgggaacgggtaacctaggacgaacttcgtaacgccgaacgtaccggtctttaatagtttatagggtcgaacggttaaggtacgaacttaaaccttcttacccgttaacacttaagtaccgtaacgtagtaggttaacgttcgttaacgtttttaac

SEQ ID NO: 436169 - DNA, 784 bp, Homo sapiens
  misc_feature: GZ8MTXP01DFFYA.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatcctttcttggtggcagcagcaacaggtgccccactcccaggttcaattggtgctagtctggagctgcggtgaagaggccgtggggcctcgagtgaacgtctcctgcaaggtcttctggttactacttttagctagttatggtgtcaggtcgtgggtgcgtacgacggtcccccgtaggaactaacggggtcttaggaggtggaagttggggtaacttgggattccgaggtactaaactttaacgaaacgttagggaaaacctaaacgaaaagttacgtaggtacctaaacgtaacttaaactttcccggaaacgggggttaccaagggtacgtacaaacgttaccgaatacggaaccaacgacgtaacaaactaactccgaaacgaacgtacaacgttacgaccccttaaagaaccgttaggaaacccgttaggaaacggggtaaacccgttggaaacggtactttacgtaacggaaccgtaaccgttaacccggtaccttttaagtttaacgtttaccgttaggtaacgtaacggttaaacggtaaacgttaaaccgttaaaccgtttaccccttaactttaaaccgaattttaacgttaaaccgtaaccgtagtaacgggttaaagtttaacgttccggttttttaaaccg

SEQ ID NO: 436170 - DNA, 741 bp, Homo sapiens
  misc_feature: GZ8MTXP01DHVS9.38.25.C03.1.454.CMB.2.raw
  modified_base (328)..(328): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaaccatcaactgcaagtccagccagtagttgtttacacgaggtaccaaacaaataagtaattactcgtctaggtacagacaagaaaccgaggacagcctactaagtcgctctatttacgngggtctacgtccggtacccggggtagttccccgggggtccctaggaccgtacttccgacggtcggacgacgggtacgggttacctgggacgaacgtaaggttactttacccgacttacctacctaacctacttaccgaacgtccgtaaccgcccgttaggacggtaacggtaccgtaacggaaacgtacggttaggggttacggttaccggtttaaaggtttttaacgtttaaaccgttcggttaacgtaacgtacgttaaggtttaactttagttaacgtttacgtacccgttacgttaaacggttccgggttttaccgggggacccggggttaacgtaacgggtccggttaaggcgttaaacgtaacgaaaaacccgtggtacggtcggttacgtaacggttccgtaaccg

SEQ ID NO: 436171 - DNA, 730 bp, Homo sapiens
  misc_feature: GZ8MTXP01EYAY7.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcgaaggtcttcgtggtttactactttttagctagttatgggtgtcgagcgtgggtgcgacgacgggcccctggaacgaaagggcttaggaggtggagtgggagtgggatacgagactaactttaacaaagtacggaaaacaaacaaaagtatacgacaataattaaacgttccgaaagggcaaggtacgtacaacttacgtaactacggaacccaaacgaaacgaaccaactaccgtacgaaacgacgtaccgtacgtacgaccgtaacgacgtaacggaaacgtagaacggggtaaactaggaaacgtacgtaccgtacgaaccggtaacgtaaccggttaactttaaagtttacgttaaggttagtaacggtaacggttaaagtaaacgttaaaccgttaaaacctttccccttaaccgtttaaacgttaaacgttaacgttaaacggtaaacggttagttacgggttaacgtttaacgtttaaccgttttaag

SEQ ID NO: 436172 - DNA, 691 bp, Homo sapiens
  misc_feature: GZ8MTXP01EQQW4.38.25.C03.1.454.CMB.2.raw
  modified_base (356)..(356): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcgagcgtgggtgcgacgacggccccgtggacgaagggcttggaggtggagtggatggatcgagcacttacaagtaggaaacanaaagtatacgactataattaacttccgaagggtacaaggagtacagtacagtacgaaccacaacgacaactacgtaccgaacggacgtaccactacgaccctagaacgtacggaaaccgttacggaaacggggtaaccgtaggtaacgtacgtaccgtacggaaaccgtaacgtaaccggttacctttaaattacgtttagttcgggtggtaacggaagtaaacggttaaaccttaaaccgtttaccccttaaccgttaaacgttaaacgttaaccgtttaacggtaacggttaacggtagggttaacgggttttctttaaccgttttttaaccg

SEQ ID NO: 436173 - DNA, 785 bp, Homo sapiens
  misc_feature: GZ8MTXP01DX5RZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccaactcccaggttcaaattggtgcagtctggagctgcggtgaagaggccgtggggcctcgagtgaacgtctccgtgcaggtcttctggttactattttagctagttatggtgtacagtcgtgggtgccgtagaccggcccctaggacgtaaagggcttaggaggtaggtagtgggtagtggaacgtacacggtactaaacctttaacaaaggttaaacggaaaacctaaacgaaaggtacctagaccaaacgtaattaacgtttacccgaaaggggtacctaaggacgttacccgaagttaacccaataccgggaaaccgtacaaacggtaaacccaacaacttaaccccgaacgggaaaacccgtacccgtaacgttaccgaaacccgttaacgaaacgttaacgggtaaaccgtacgggaaacccgggtaaaccgtacggaacgttacccgtacgtaaccggaaaccgtaaccgtaaccgttactttaattaagttacgtacggtaacgaacggaaacgtaacgttaaaacttaaacccgtttacccttacgttaaacgttaactttaacgtaaagtaaccgtagttaccggttaagtttaaccgtttaacgttttaaccg

SEQ ID NO: 436174 - DNA, 669 bp, Homo sapiens
  misc_feature: GZ8MTXP01EQ5JS.38.25.C03.1.454.CMB.2.raw
  modified_base (583)..(583): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactactttttagctagttagtggtgtcgagtcgtgggtgacgacgacggccccgtggaacgaagggtcttggagtagggagtggggatggatacgaggtctaacgttaacaagtaggaaaccaagtaaaagtataccggactaaactaacgttaaagtttacccgaaaggggactaaggtacgtacaattacgaacgtgaaacccaacacgaaccacaacgtaccaacggactaacccaccgtacgaccccttaagacgtacggaaacgtcggtaaacggggaaacccgttaggaacgtactacgtacgaaccgacgtaacggtacttaaattnttagtgcgtagaggtaacttaactaactttacccttacgttattacgttaagtacgcgttagtagttacgttcgttaactttaacg

SEQ ID NO: 436175 - DNA, 670 bp, Homo sapiens
  misc_feature: GZ8MTXP01C39GT.38.25.C03.1.454.CMB.2.raw
  modified_base (590)..(590): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttatggtgtcagtcgtggtgcgacacggcccctaggacgaagggcttggaggtggagttgggagtggatacgagactactttaacaagtaggaaaacaacaaagtatcgacaactaattaacgtttccgaaaggggacaaggtagtactaatcaatacgaacaacgaacgacaacctaacacccgaacggaacgcctaacggtacaccctaacgagtacggaaacgtaggaacgggggtaaacctgggaaacgacgttacgtacggacgaaccggtaaccggtacctttaagttaccgttattgggtaacgacgttaaacgggtanaaaccttaaacgtccctttaacttacgttaaattaacgaaacgtcgtaaggtagggttaacgtttcggttctttttaacg

SEQ ID NO: 436176 - DNA, 696 bp, Homo sapiens
  misc_feature: GZ8MTXP01B93ER.38.25.C03.1.454.CMB.2.raw
  modified_base (222)..(222): a, c, t, g, unknown or other
  modified_base (387)..(387): a, c, t, g, unknown or other
  modified_base (681)..(681): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagcgtgcggtgaaggaggccgtggggcctnagtgaacgtctcctgcaggtcttctggttactacttttagctagttagtggtgtcagcgtgggtgccgacgacggtcccctagggacgtaaggggtcttaggaggtgggtagtggggtatggatacgagactaactttaacgaagtaggaaaacacgtaaaggtntacgacaactaagttaacgttaccgaaagggtacaaggtacgttacgatacgaagtacgaacccaacacgaacaacctacgtacccaacggacgacctaacgtcgtaccctaacgagtaacggaacgtacgggaacggtaaaccgtggaacgtacttcggaacgaccgtaacgtaccggttacctttaattagtttacgttggtaagtaccggaaagtaccgttaacttaaaccgtttacccttacccttattaacttaacgttacccggaagttaggtaggttaaccggtttntttaacgttttaacg

SEQ ID NO: 436177 - DNA, 764 bp, Homo sapiens
  misc_feature: GZ8MTXP01C3KCX.38.25.C03.1.454.CMB.2.raw
  modified_base (245)..(245): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactaccaggttcaattggtgcagtctggagctgcggtgaagaggccgtggggcctcgagtgaacgtctcctgcaaggcttntaggttacacttttagctagttatgtgtcagtcgtgggtgccgacgacggcccgtaggacgaagggcttggagtgggagtgggaagtggtataccgaggtctaacgtttaacgaagtacggaaacacgtaaagtaccgtaggactaacgtaagttaactttaccggaaaggggttaccaaggtaaacggttacccgtaaattacgaaccgtacgggtaaccccaaacacgggtaaaccaccgaaactacccgaaacggtacggacctaacgttaccggaacccttaaccgaagttaacgggaaacgttacggaaacgggggaaaccttaggggaaatacgtaccgtaacgaacccgtacgtaaaccgggttaccttaaggtatttacgttgggtaataaccgggaaggtaaacgttaaacgtaaaccctttacccgttaccgttaacgttaaattaaccgggtttaaaccgggcttaaagggtaccggttaagggttaaccgttcgttttttaaacccg

SEQ ID NO: 436178 - DNA, 723 bp, Homo sapiens
  misc_feature: GZ8MTXP01EJSEE.38.25.C03.1.454.CMB.2.raw
  modified_base (468)..(468): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcgagtgaacgtctcctgcaaggtcttgtgttactacttttagctagttattggtgtcagcgtgggtgacggacagggtccccgtggaacgaagggcttggagtgggagtgggatcggatacgagtactaactttaaacgaataaggaaaccaacgtaaaagtgtacgactaactaaagttaaacgtttacccggaaacggggtacaaggggtaaattacccaaattaccgaaatacgaaacccgaaanaacgaaccaaacctacgaccaaacggacaaccgactaccggtacctaaaccgaagttacggaaacgtacggtaaacggggaaccggttaagaacgtacgttacgacggaacgtacgtaaccggttaccttagttaattagttagggtaagtaaccgggaaagtaacgttaaaccttaaacttaccgttacccgtttaattaacttaacgttaacggaacgttaagtaggttaagttcggttttaactttttaacg

SEQ ID NO: 436179 - DNA, 754 bp, Homo sapiens
  misc_feature: GZ8MTXP01BFHZV.38.25.C03.1.454.CMB.2.raw
  modified_base (220)..(220): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggacctnagtgaacgtctctgctaaggtcttgtgttactacttttagctagttatggtgtcaggtcgtgggtcgcgacgacggtccccgtaggaccgtaagggtccttaggaggtgggtagtaggggtagtaggactacgacgtacctaaactttaaacgtaacggttaaggaaaacgtaacgtaaaagtacgttaccgactaacgtaaacgttaaacgtttcccggaaagggtaccaagggtacttactaaacttaccgacgttaacccgaaacgaaacgaacgaaaccaccttaacaacctacgggaactacgtaccttacggaccctaacgacgtaagtaaaccgtagaaacgggggttaaccctagggtaagtacccgtaaactcggaaaccgtaaccgttaacggttacctttaagttaacgttcggttagtaacggaacgttaaggaaacttaacgtaaacctttcccttaactttaggttaacttaacggttaacgaacgttaggttggaaacgtttcgtttaacgttttaacg

SEQ ID NO: 436180 - DNA, 513 bp, Homo sapiens
  misc_feature: GZ8MTXP02JKQMG.38.25.C03.1.454.CMB.2.raw
  modified_base (368)..(368): a, c, t, g, unknown or other
  modified_base (447)..(447): a, c, t, g, unknown or other
  modified_base (453)..(453): a, c, t, g, unknown or other
tcagtcgatcacgtcacgaccggtgctcgatttagtagtgtagatttgggtttggggacccaaaaccacacccctccttgggagaatcccctagatcacagctcctcaccatggactggacctggagcatccttttcttggtggcagcagcaacaggtacccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataattccagggcagngtcatcatgacacagacacatccagagcactgcctacataggaactgaggaacctgagatcgagacgacacggccttanattatntgcgagagaacaaattcctacttacatattaacgacgatacggaatgtactttattttac

SEQ ID NO: 436181 - DNA, 507 bp, Homo sapiens
  misc_feature: GZ8MTXP02IWVDA.38.25.C03.1.454.CMB.2.raw
tcagtcgatcacgtcacgaccggtgctcgatttagtagtgtagatttgggtttgggagctacaacaggcaggcagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaacccaggacagcctcctaagttgctcatttactgggcatctacccgggagtccggggtccctgaccgattcagcggcagcgggtctgagacagatttcactctcaccatcagcagccctgccaggctgaagatgtggcagtttattactgtcagcagtattatagtagtctcagtacttttggccgggggtaccaagctggagatcgaaaacgactagtggactgcac

SEQ ID NO: 436182 - DNA, 517 bp, Homo sapiens
  misc_feature: GZ8MTXP02I79KZ.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccggggtcctgaccgattcagcgcagcgggtctgagacagatttcactctcaccatcagcagcctgcaggctagaagatgtggctagtttatactgtcagcagtattatagtagtctctacgtacgtttggaccggggtacaacgtcgtacggagagtaacgaaacgaacgtagaggctcgacaacc

SEQ ID NO: 436183 - DNA, 499 bp, Homo sapiens
  misc_feature: GZ8MTXP02GGMG2.38.25.C03.1.454.CMB.2.raw
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccggggtcctgaccgatcagcggcagcggtctgagacagatttcactctcaccatcagcagcctgcagctgagatgtgctagtttatactgtcagcagtatatagtagtctcagtactttggccggggtacaacgcgtaggagatcgaaacgactgtaggctacgcaacc

SEQ ID NO: 436184 - DNA, 610 bp, Homo sapiens
  misc_feature: GZ8MTXP02H018K.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttttagctagttatggtgtcagcgtgggtgcgacgacggcccctggaccgaaggggcttggaggtggagtgggatggatcgagcacttacaataggaaaacacgaaagtatagacaacaattaaactttccgagggcaggagtcatcatcgaccacacgacacatacccaagagacactcgaccctaacgatggaaacctggaaacgaacctgaacgtatacgtacgaacgacgtaccggtacctttaagtaatttagttggtacgacggaagtaacgtaaacgtaaaacttttccctacctttaacaacttaacgttaacgaacgtagttaaggtaacgttacgttacttttaacg

SEQ ID NO: 436185 - DNA, 509 bp, Homo sapiens
  misc_feature: GZ8MTXP02J2YGB.38.25.C03.1.454.CMB.2.raw
  modified_base (372)..(372): a, c, t, g, unknown or other
  modified_base (487)..(487): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacacttttagcagttatggtgtcagctgggtgcgacaggccccctggacaagggcttgagtggatgggatggatcagcacttacaatggaaaacacaaagtatgcacataatttccaggggcngagtcatcatgaccacagacacatccacgagcactgcctacatggaactgaggaacctgagatctgacgacacggccttatattatgtcgcgagacgacaaattccacttacatnttacgacgataggatgtcttta

SEQ ID NO: 436186 - DNA, 520 bp, Homo sapiens
  misc_feature: GZ8MTXP02H63KA.38.25.C03.1.454.CMB.2.raw
  modified_base (384)..(384): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcagaggccaccatcaactgcaagtccagccagagtgtttacacaggtccaacaataagattactcgcttggtaccagcagaaaccaggacagcctacctaaagttgctcatttactgggcatcgtacccgggagtcccggggtcctgaccgatcagcgcagcggtctgagacagatttcactctcacctancagcagcctgcaggctgagatgtggctagtttattactgtcagacagtattatagtacgtctctacgtacgtttggaccgggtaccgtaagcgtacggagaacgtaacgaaaacgacgtacgtagcgtcgacaccg

SEQ ID NO: 436187 - DNA, 568 bp, Homo sapiens
  misc_feature: GZ8MTXP02HBIHF.38.25.C03.1.454.CMB.2.raw
  modified_base (532)..(532): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggctgagtggagtgggatggatcgagcacttacaagtaggaaaacacaaaagtatcgacaactaattaaatttccgaaggggcaggtagtacaatcatacgaaccaacagacaacatacccaacgagcactcgaccctaacagtacggaaactggaacggaacctgaagatacgagacgacacggtcttaatatttattgtagcgaagacgaactaaactttcctacccttaanaataacttaacgaacgtataggaacttgtactttag

SEQ ID NO: 436188 - DNA, 510 bp, Homo sapiens
  misc_feature: GZ8MTXP02IRYM3.38.25.C03.1.454.CMB.2.raw
  modified_base (429)..(429): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataatttccagggcagagtcatcatgaccacagacacatcacgagcactgctacatggaactgagacctgagatcngacgacgacggaccttatattattgtagcgagagacaaacttcctaccttacattaagtacgacgataggaatgactttag

SEQ ID NO: 436189 - DNA, 507 bp, Homo sapiens
  misc_feature: GZ8MTXP02JSZWL.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacgttacaatggaaacacaaagtatgacacataatttccaggacagagtcatcatgaccacagacacatccacgagcactgcctacatggaaactgaggaacctgagatctagacgacacggcttatattatgtgcgagagacaaattccacttacataatacgacgatggaagtgacttta

SEQ ID NO: 436190 - DNA, 508 bp, Homo sapiens
  misc_feature: GZ8MTXP02FZKLY.38.25.C03.1.454.CMB.2.raw
  modified_base (443)..(443): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagttgctcatttactgggcatctacccgggagtccggggtcctgaccgattcagcgcagcggtctgagacagattcactctcacatcagcagctgcaggctgaagatgtggctagtttattactgtcagcagtatatagtagtctntagtacgtttgggccggggtaccaagcgtaggagataacgaaacgaactcgtaggctagactaac

SEQ ID NO: 436191 - DNA, 513 bp, Homo sapiens
  misc_feature: GZ8MTXP02FVUK7.38.25.C03.1.454.CMB.2.raw
  modified_base (311)..(311): a, c, t, g, unknown or other
  modified_base (440)..(440): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttacngggcatctacccggggagtcccggggtcctgaccgattcagcggcagcgggtctgagacagatttcactctcaccatcagcagccctgcaggctgaagatgtggcagtttatactgtcagcagtattanagtagtctcagtactttgggaccgggggtaccaaagcgtaggagataacgaaacgaacgtgtggctcgcaacc

SEQ ID NO: 436192 - DNA, 511 bp, Homo sapiens
  misc_feature: GZ8MTXP02ISEF8.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataatttccaggcagagtcatcatgaccacagacacataccacgagcactgcctaacatgaactgaaggaacctgagatcagacgacacggtaccttatattatgtgacgagagactaaattcctacttacataatacgacgatggaagtcgtacttta

SEQ ID NO: 436193 - DNA, 509 bp, Homo sapiens
  misc_feature: GZ8MTXP02HNDM0.38.25.C03.1.454.CMB.2.raw
  modified_base (311)..(311): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttacnggcatctaccgggagtccggggtcctgaccgattcagcggcagcgggtctgagacagtattcactctcaccatcagcagcctgcagctgaagatgtgctagtttatactgtcagctagtattatagtagtctactacgtacgtttgggaccggggacaacgcgtaggagataacgaaacgaactgtaggctcgacacg

SEQ ID NO: 436194 - DNA, 617 bp, Homo sapiens
  misc_feature: GZ8MTXP02F4DG0.38.25.C03.1.454.CMB.2.raw
  modified_base (352)..(352): a, c, t, g, unknown or other
  modified_base (392)..(392): a, c, t, g, unknown or other
  modified_base (427)..(427): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagctgggtgcgacaggcccctggacaagggcttgagtggatgggatggatcagcacttacaataggaaacacaaaagtntagacacaataatttccagggcagagtcatcatgaaccanaagacacataccaacgagacaactgacccctaaanagtacggaaactaggaaacggaacctaggaagtacgtacgtaacgaaccgaaccgtaaccggttacctttaagttaagtttagttaggtacggtacggtaaagtaaacgtaaacttaaactttacccttaaccttaacgtaaacttaacgttaacgaaacgtaagtacggtaaacgttcgttactttacg

SEQ ID NO: 436195 - DNA, 593 bp, Homo sapiens
  misc_feature: GZ8MTXP02IA7OV.38.25.C03.1.454.CMB.2.raw
  modified_base (372)..(372): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaaacacaaaagtatacgacacataatttccagggcngagtcatcatgaccacagacacatccacgagcaactgacctacagtacggaaactggaacggaacccttgaacgatactaggaaccgaacgaaccggtccttaaattagttattaggtagaccgtaaggaaacgtaactaaaaactttccccttaccttaaacaacgttaactttaaaccgaaccggtagtaagggtaaacgttcggtaacctttttaacg

SEQ ID NO: 436196 - DNA, 622 bp, Homo sapiens
  misc_feature: GZ8MTXP02J19QB.38.25.C03.1.454.CMB.2.raw
  modified_base (412)..(412): a, c, t, g, unknown or other
  modified_base (427)..(427): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacttacaagtaggaaacacaaagtatcgacacattaacttccgagggcagagtacatcatgaccacacgaacacacaccacggacncactacgaccctaanatacggaaactaggaacgggaacctgaaggtacttacgtacggaaccggaaccgtaaccgggtcctttaattaacgtttaacgttggttacggaccggaaagaacggtaaaacctaaactttaccctaaccctttaaccaattaacgtttaaaccgacgtaacgtacggggtaaacttcggttacctttttaacg

SEQ ID NO: 436197 - DNA, 535 bp, Homo sapiens
  misc_feature: GZ8MTXP02G4O6M.38.25.C03.1.454.CMB.2.raw
  modified_base (419)..(419): a, c, t, g, unknown or other
  modified_base (502)..(502): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaaggggcttggagtggagtgggatggatcagcacttacaatggaaaacacaaagtatcgacacataactttccagggcagagtcatcatcgaccacagacacatccacgagcactgacctanagtagaactgaacggactgagatacgtagacgacacggtacttatattatgtcgacgagacgaactaaacttcctaccttaanataagttacgacgtataggaagttcgtatttac

SEQ ID NO: 436198 - DNA, 512 bp, Homo sapiens
  misc_feature: GZ8MTXP02JPFVU.38.25.C03.1.454.CMB.2.raw
  modified_base (391)..(391): a, c, t, g, unknown or other
  modified_base (498)..(498): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggatgggatggatcagcactacaatggaaacacaaagtatgacacataattccagggcagagtcatcatgaccacagacacanccacgagcactcgcctacatcggaaactggaaggaacctgagactctagaccgacacggccttagtattagtgtcgacgagagacaattcctactacataatacganatgatacgctttag

SEQ ID NO: 436199 - DNA, 536 bp, Homo sapiens
  misc_feature: GZ8MTXP02JZ59W.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacactttttagcagttatggtgtcagctgggtgcgacaggcccctggacaagggcttgagtggatgggatggatcagcacttacaatggaaacacaaaagtatgacacataatttcgagggtcagagtcatcatgaccacagacacactccacgagcactcgaccctacataggaaactggaacggaacctgagatcgtgacgacacggaccttagtattatgtagcgagacgactaaacttcctaccttacaattaattaacgacgtataggagtcgtacttttaag

SEQ ID NO: 436200 - DNA, 520 bp, Homo sapiens
  misc_feature: GZ8MTXP02IH0X3.38.25.C03.1.454.CMB.2.raw
tcagtcgatcacgtcacgaccggtgctcgatttagtagtgtagatttgggtttggggacccaaaaaccaacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacactttttagcagttatggtgtcagctgggtgcgacaggcccctggacaagggcttgagtggatgggatggatcagcacttacaatggaaaacacaaaagtatgacacataattccagggcagagtcatcatgacacagacacatccacgagcactgcctacatgaaactgaacggaacctgagatctagacgacacggtccttatattagttgtagacgagacgaacaaattcctacttacataattacgacgtataggaatgacttta

SEQ ID NO: 436201 - DNA, 517 bp, Homo sapiens
  misc_feature: GZ8MTXP02HTCGM.38.25.C03.1.454.CMB.2.raw
  modified_base (385)..(385): a, c, t, g, unknown or other
  modified_base (451)..(451): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaatggaaacacaaagtatgacacataaactttcagggcagatcatcatgaccanagacacataccagagcactgcctacatcggaactgagaacctgagatctgacgacacggcttaatntattgatcgatacgaactaaacttcctaccttaacattaattacgacgtatggaaatgtactttta

SEQ ID NO: 436202 - DNA, 526 bp, Homo sapiens
  misc_feature: GZ8MTXP02IK4BK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacagggcttgagtggagtgggatggatcagcacttacaataggaaacacaaagtatacgacacataatttccaggggcagagtcatcatcgacacagacacatccacgagacactgacctacatggaaactggaacggaacctgagatactagacgacacggtacttatattatgtcgacgagacgaactaaacttcctacttacataatacgacgtatagaagtgtacttta

SEQ ID NO: 436203 - DNA, 516 bp, Homo sapiens
  misc_feature: GZ8MTXP02H8BK1.38.25.C03.1.454.CMB.2.raw
  modified_base (249)..(249): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacaggtccaacaanaagaattactcgcttggaccagcagaaaccaggacagcctcctaaagttgctcatttactgggcatctacccgggagtcccggggtcctgaccgatcagcggcagcgggtctgagacagtatttcactctcaccatcagcagccctgcaggctagagatgtgctagtttattactgtacagcagtattatagtagtctactagtacgtttgggaccgggtacgaacgcgtaggacgataacgaaacgaacgtagtagctacgacacg

SEQ ID NO: 436204 - DNA, 503 bp, Homo sapiens
  misc_feature: GZ8MTXP02GK8EO.38.25.C03.1.454.CMB.2.raw
  modified_base (405)..(405): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaaagttgctcatttactgggcatctacccgggatccggggtcctgaccgattcagcgcagcggtctgagacagattcactctcaccatcagcagcctgcagctgaagatgngcagtttatactgtcagcagtatatagtagtctactagtacgtttggccggggtaccaaggcgtaggagataacgaaacgaactaggtgctagacaac

SEQ ID NO: 436205 - DNA, 518 bp, Homo sapiens
  misc_feature: GZ8MTXP02JJWWB.38.25.C03.1.454.CMB.2.raw
  modified_base (410)..(410): a, c, t, g, unknown or other
  modified_base (430)..(430): a, c, t, g, unknown or other
  modified_base (490)..(490): a, c, t, g, unknown or other
tcagtcgatcacgtcacgaccggtgctcgatttagtagtgtagatttgggtttggggacccaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggatgggatggatcagcacttacaatggaaaacacaaaagtatagcacataattccagggcagagtcatcatgaccacagacacatccacgagcactgcctanatggaactgaggaacctganatctagacgacacggtccttatacttatgtagacgagtacgactaaacttcctaccttanataattacgacgataggatcgactttac

SEQ ID NO: 436206 - DNA, 736 bp, Homo sapiens
  misc_feature: GZ8MTXP02G35E3.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagctgggtgcgacaggcccctggacaagggcttgagtggatgggatggatcgagcacttacaataggaaaacacaaagtatacgacaactaattaaactttcccgaaggggtaccagggtaacgttccaaagttaccaagttacggaaacccaacaaacgaaccaaacgaactacccaaacggacgaccaacctcggaccctaacgaacgttacgggaaaaccgttcggaaacgggtaaacccgttagggaaacggtaacgtttaccgtaacggaacccggaaccgtaacccggggtacccttttaaacgttaacgttttaagtttacggttacgggaccggtaaaggtaaacggtaaaccttaaaacgtttccccgttaacccgtttaactaaacgtttaacgtttaaaccggaaaccggttaacggttacgggtaaacggtttacggtaaccttttttaacgg

SEQ ID NO: 436207 - DNA, 568 bp, Homo sapiens
  misc_feature: GZ8MTXP02HGKJR.38.25.C03.1.454.CMB.2.raw
  modified_base (349)..(349): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggctgagtggatgggatggatcagcacttacaatggaaaacacaaaagtancgacatataattcgaggacagatacatacatacacaacaacaacaacacaccacgacgacacacgactaacagtagaaacgtacgaacggaacgtagagagtacgtacgacgaacgacgtacttaattattagttagtacgacgagaacgaaactaaacttacctaccttaactaactaacgtaacgtaacgtacgtaagtaacgtacgttactttacg

SEQ ID NO: 436208 - DNA, 515 bp, Homo sapiens
  misc_feature: GZ8MTXP02FU6W1.38.25.C03.1.454.CMB.2.raw
  modified_base (385)..(385): a, c, t, g, unknown or other
  modified_base (403)..(403): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggatgggatggatcagcacttacaatggaaacacaaagtatgcacataattccagggcagagtcatcatgaccacanacacataccacgagcacngcctacatggaactgagaacctgagatctagacgacacggaccttatagttattggtagcgagagaactaaacttcctacttacataattacgacgataggagtcgacttta

SEQ ID NO: 436209 - DNA, 507 bp, Homo sapiens
  misc_feature: GZ8MTXP02FICXD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggatgggatggatcagcacttacaatggaaacacaaaagtatgacacataatttccagggcagagtcatcatgaccacagacacatccacgagcaactgcctacatggaaactgaagaacctgagatctgacgacacggccttatattatgtgcgagacgacaaatcctactacataatacgacgatggaaatgcttta

SEQ ID NO: 436210 - DNA, 508 bp, Homo sapiens
  misc_feature: GZ8MTXP02GRKWG.38.25.C03.1.454.CMB.2.raw
  modified_base (361)..(361): a, c, t, g, unknown or other
  modified_base (444)..(444): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgttctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccggagtccgggtcctgaccgatccagcgcagcggtctgngacagattcactctcaccatcagcagcctgcaggctgaagatgtggctagtttattactgtcagcagtattatagtagtcctnagtactttgggaccggggtacaaagcgtcggacgatacaaacgaacgtgtaggctcgacactag

SEQ ID NO: 436211 - DNA, 552 bp, Homo sapiens
  misc_feature: GZ8MTXP02G8BXQ.38.25.C03.1.454.CMB.2.raw
  modified_base (349)..(349): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaaacacaaaagtntagacacaataactttccgagggacagagtacatcatgaaccacagacacataccacgagacactgaccctaacagtaggaaactaggacgaaacctgagatcagacgacacggtccttaatattagtgtagacgtagacgaactaaaacttcctacttaacattaagttaacgaacgtataggaacgttcgtacttttaacg

SEQ ID NO: 436212 - DNA, 597 bp, Homo sapiens
  misc_feature: GZ8MTXP02JD6T9.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggcttgagtggatgggatggatcagcacttacaatggaaaacacaaaagtatacgacaacaataaactttccgaagggcagagtacatcatacgaaccacaagaacacactaccaacgacgacactcgacctaacagtacggaaactggaaggaaaccctggaagagtacctagaaccggaactaccgggtacctttaagtaattagttggtagacgaagaacgtaaactaaaacgtttccctaaccttactaattaacgttaacgaacgtactaggaaagttcgtactttttaacg

SEQ ID NO: 436213 - DNA, 525 bp, Homo sapiens
  misc_feature: GZ8MTXP02JH9WP.38.25.C03.1.454.CMB.2.raw
  modified_base (410)..(410): a, c, t, g, unknown or other
  modified_base (428)..(428): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcagcacttacaatggaaacacaaagtatgcacataattccagggcagagtcatcatcgaccacagacacataccacgagcactgcctanatggaactgagaactgantactgacgacacggtactatactatgtgcgagacgacaaactttcctaccttaacattaacgtaacgacgtaagtaggtaagttcgtacttttaacg

SEQ ID NO: 436214 - DNA, 559 bp, Homo sapiens
  misc_feature: GZ8MTXP02F4IDC.38.25.C03.1.454.CMB.2.raw
  modified_base (400)..(400): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacttacaagtaggaaaacacaaagtatacgacacataactttccgaaggggcaggagtacatacatacgaccanagacaacactacccacgagcactcgacctacagtaggaaactggaacggaacctgacgatacgagacgacacggtaccttatattagttgtagacgtagacgtaactaaacttccctactacaactaagttaacgacgtagtggaattcgtacttttag

SEQ ID NO: 436215 - DNA, 504 bp, Homo sapiens
  misc_feature: GZ8MTXP02GKWOZ.38.25.C03.1.454.CMB.2.raw
  modified_base (448)..(448): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttactgggcatctacccgggagtccggggtcctgaccgacttcagcggcagcgggtctgagacagatttcactctcacatcagcagccctgcaggctagaagatgtggctagtttatactgtcagcagtatatagtagtctnagtacgtttgggccgggtacagctaggacgataacgaaacgactgtcgctgacaac

SEQ ID NO: 436216 - DNA, 538 bp, Homo sapiens
  misc_feature: GZ8MTXP02F62PV.38.25.C03.1.454.CMB.2.raw
  modified_base (414)..(414): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaagtaggaaaacacaaaagtatacgacacaataaactttccgagggacagagtacatcatacgaccacagacacataccacganacactcgacctacagtacgaaactggaggaacctagagatacacgacgacacggtacttatattagtgtagacgagacaactaacttcctactacataagtacgacgtatagtaatgtacttta

SEQ ID NO: 436217 - DNA, 526 bp, Homo sapiens
  misc_feature: GZ8MTXP02JB5BN.38.25.C03.1.454.CMB.2.raw
  modified_base (386)..(386): a, c, t, g, unknown or other
  modified_base (436)..(436): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataatttccgagggcagagtcatcatgaccanacgacacactccacgagcactgcctacatgaactgacggacctgagatcngacgacacgtcttatatattgtgcgagacgaactaaacttccctacttaacaattaacgttacgaacgtataggaaacgtgtacttttaa

SEQ ID NO: 436218 - DNA, 561 bp, Homo sapiens
  misc_feature: GZ8MTXP02HRPKB.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcacttacaataggaaaacacaaagtatcgacacattaatttccgaggggcagagtcatcatgaccacagacacatccagagtcaactcgacctacatggaaactgagacctgagatcgtgacgacacggtccttaagtatttaagttgtgacggaggaagaaacctaaaactttcccttaccttaacctaattaacgtttaaccgaacgtagtaggaaacgttgtacctttttaacg

SEQ ID NO: 436219 - DNA, 580 bp, Homo sapiens
  misc_feature: GZ8MTXP02G9ETD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacagggcttggagtggagtgggatggatcagcacttacaatggaaaacacaaagtatacgacacataactttccaggggtcagagtcatcatgaccacagacacactaccacgagcactcgacctacatggaaactgaacggaacctgagactacgtagaacgacgacggtccttaataatttagttacgtaggaccgtaaggaacgtaactaaaactttccctaaccctttaactacttaacgttaaccgaacgtaacgtaggtaaagttacggtactttttaacg

SEQ ID NO: 436220 - DNA, 543 bp, Homo sapiens
  misc_feature: GZ8MTXP02IN10Q.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcgagcacttacaataggaaacacaaaagtatagacacataatttcaggcagagtcatcatgaccacagacacataccacgagcactcgacctacatacggaaactaggaacggaacctgaagtataccgtagaccgacgacggtaccttatattagttgtgacgagacaaactaaacttcctacttaacattaacttacgactataggtaatcgtacttttag

SEQ ID NO: 436221 - DNA, 535 bp, Homo sapiens
  misc_feature: GZ8MTXP02IKGET.38.25.C03.1.454.CMB.2.raw
  modified_base (433)..(433): a, c, t, g, unknown or other
  modified_base (438)..(438): a, c, t, g, unknown or other
  modified_base (470)..(470): a, c, t, g, unknown or other
  modified_base (495)..(495): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcattacaatggaaacacaaagtatgacaacataaatttcagggacagagtcatcatgaccacagacacataccagacgcactgacctacatagaactgagaacctganatacngacgacacgtacttatattatagtcgacgtanacgtaactaaacttcctaccttaanacttaattacgaacgtatacggaaacgttgtacttttaag

SEQ ID NO: 436222 - DNA, 540 bp, Homo sapiens
  misc_feature: GZ8MTXP02G5JUO.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacacttttagctagttatggtgtcagctgggtgcgacaggcccctggacagggctgagtggatgggatggatcagcacttacaatggaaacacaaagtatgacacataattccagggcagagtcatcatacgaccacagacacataccgagagcactgacctacactggaaactgaaggaacctgagatcgtagacgtacacggtccttatattagtgtacgcgagacgaactaaacttcctaccttaatactaacgttaacgaacgtataggtaacgtgtacttttaacg

SEQ ID NO: 436223 - DNA, 595 bp, Homo sapiens
  misc_feature: GZ8MTXP02JLJ8W.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaaacacaaagtatgacacataactttccagggcagagtcatcatgaccacagacacatccaacgagacactcgacctaacatacggaactaggaacggaaccctgaacgtactacgtagaaccgaacgaccgggtaccttaagttaatttaagttaggttacggacggaaagacggtaaacctaaaactttccctaacctttaacctaattaacgtttaacggaaccgtaagtacggtaaagttcggtactttttaacg

SEQ ID NO: 436224 - DNA, 510 bp, Homo sapiens
  misc_feature: GZ8MTXP02ILGWD.38.25.C03.1.454.CMB.2.raw
  modified_base (353)..(353): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcacttacaatggaaacacaaagtatgcanataatttcagggcagagtcatcatgaccacagacacatccacgagcactgcctacatggaactgaagaacctgagatcgtgacgacacggaccttatattattgtgcgtagagacaaattcctaccttacataatacgacgatggaatgacttttac

SEQ ID NO: 436225 - DNA, 514 bp, Homo sapiens
  misc_feature: GZ8MTXP02JVSM0.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttactgggcatccgtacccgggagtccggggtccctgaccgattcagcggcagcgggtctgagacagattcactctcaccatcagcagcctgcaggctgagatgtgctagtttatactgtcagcagtattatagtagtctctagtacgtttgggccggggtaccaagcgtaggagagtaacgaaacgtaacgtgtaggctagacaccg

SEQ ID NO: 436226 - DNA, 546 bp, Homo sapiens
  misc_feature: GZ8MTXP02H473Y.38.25.C03.1.454.CMB.2.raw
  modified_base (388)..(388): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaaacacaaaagtatgacactataatttccgagggcagatcatcatcgaccanagacacataccacgagcactgccctaacatggaaactgaacggaacctgagatcagacgacgacggtacctttaagtattagttgtacgcgtaagacgtaaactaaaacttccctaccttaacataagttaccgacgtataggaacgttgtactttta

SEQ ID NO: 436227 - DNA, 558 bp, Homo sapiens
  misc_feature: GZ8MTXP02GK6Z8.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaatggaaaacacaaagtatgacacataattccagggcagagtcatacatcgaccacaagacaacatccaacgagacactcgacctaacatagggaactggaagacctagagtatctaggacgacgacggtccttaagtattaatggtacgcgtaagacgaactaaacttacctaccttaacaattaacgttaccgtaagtactaggtaaagttcggtacttttaacg

SEQ ID NO: 436228 - DNA, 632 bp, Homo sapiens
  misc_feature: GZ8MTXP02HTHFK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttgagtggatgggatggatcagcacttacaatggaaacacaaagtatacgacacataatttcgagggcagagtacatacatacgaccacagacacatccacgacgcaactcgaccctacagtaggaaacctgaaggtaaaccgtgaacgtagtctaggaaccgacgtaaccgggtaccttaattaacgtttaagttggttacgtacggaaaggaacggtaaaaccgtaaaaacgtttccccttaaccctttaaaccgtaatttaaacgttaaacccgtaaaacggtacgttaacgggtaaaaggtttacggttaacgttttttaaaccg

SEQ ID NO: 436229 - DNA, 559 bp, Homo sapiens
  misc_feature: GZ8MTXP02GC19T.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacttacaatggaaacacaaagtatgacacaataattccagggcagagtcatcatgaccacagacacataccacgagacactcgacctacatggaaactgaaacggaacctgaagtatacgacgaacgaacgacggtaccttataatttaagttgtagacgaagacgaaactaaaacttcctaaccttacaattaacgttaacgaacgtaacgtaggtaacgtgtacttttaac

SEQ ID NO: 436230 - DNA, 525 bp, Homo sapiens
  misc_feature: GZ8MTXP02JHJUL.38.25.C03.1.454.CMB.2.raw
  modified_base (373)..(373): a, c, t, g, unknown or other
  modified_base (389)..(389): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggatgggatggatcagcacttacaatggaaaacacaaaagtatgacacaataatttccaagggcngagtcatcatgaccanagacacataccagagacactcgcctaacatgaaactgaaggaacctgagatactagacacgacggcttatattatgtcgagagacgacaaacttcctactaacataagttaacgacgagtggaacgtgacttttaa

SEQ ID NO: 436231 - DNA, 526 bp, Homo sapiens
  misc_feature: GZ8MTXP02GZ9IB.38.25.C03.1.454.CMB.2.raw
  modified_base (444)..(444): a, c, t, g, unknown or other
  modified_base (460)..(460): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcaagaaaccaggacagcctcctaaagttgctcatttctgggcatcctacccgggagtccggggtcctgaccgacttcagcgcaggcggtctggagacaggtactttcactctaccacccataccagcacgccctgccaggctagagatgtggctagtttatactgtcancagtatatagtatctntacgtactttgggacgggtaccaagcgtaggacgataacgaaacgaacgtgtacgctcggactacc

SEQ ID NO: 436232 - DNA, 594 bp, Homo sapiens
  misc_feature: GZ8MTXP02JL0UX.38.25.C03.1.454.CMB.2.raw
  modified_base (368)..(368): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataatttccagggcngagtcatcatgaccacagacacatccacgagcactcgacctacatggaaactggaacggaacctgaagactactagaaccgacgtaaccgggcctttaagttaatttaagttcggttaggacggtaaagaacggaaactaaaaactttcccttaacctttaacctaaattaacgtttaaaccggaaaccggtaattagggtaaaacgttacgtacctttttaaacg

SEQ ID NO: 436233 - DNA, 538 bp, Homo sapiens
  misc_feature: GZ8MTXP02F796B.38.25.C03.1.454.CMB.2.raw
  modified_base (388)..(388): a, c, t, g, unknown or other
  modified_base (504)..(504): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcagcacttacaagtggaaaacacaaaagtatgacacataatttccagggcagagtcatcatgaccanagacacataccacgagcaactcgaccctacatagggaaactggacgaacctgagactactagacgacgacggaccttatattattgtgacgtagagaactaaacttcctaccttanactaattacgacgacgtagtaacgtgtactttaa

SEQ ID NO: 436234 - DNA, 532 bp, Homo sapiens
  misc_feature: GZ8MTXP02F4ZSP.38.25.C03.1.454.CMB.2.raw
  modified_base (391)..(391): a, c, t, g, unknown or other
  modified_base (397)..(397): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttatggttacactttttagcagttatggtgtcagctgggtgcgacaggcccctggacaagggcttgagtggatgggatggatcagcacttacaataggaaaacacaaaagtatagacaacataaatttccagggcagagtcatcatgaccanagacanatccagagcactgcctacatggaaactgaagggaacctgagatctacgacgacacgggtaccttatattatgtcgacgtagacgaactaaacttcctacctacataagttacgacgtataggtaatcgtacttta

SEQ ID NO: 436235 - DNA, 543 bp, Homo sapiens
  misc_feature: GZ8MTXP02H55CK.38.25.C03.1.454.CMB.2.raw
tcagtcgatcacgtcacgaccggtgctcgatttagtagtgtagatttgggtttggggacccaaaaaccacacccctcccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaaggggcttgagtggatgggatgggatcgagcattacaataggaaaacacaaagtatgacaacataatttccagggtcagagtcatcatcgaccacacgacacactccacgagcaactcgacctacataggaactgacgaacctgagataccgtagacgacacggaccttatattagtgtgacgtagacgaacaaacttccactttacattaacgttaacgacgtataggaacgttcgtactttacg

SEQ ID NO: 436236 - DNA, 544 bp, Homo sapiens
  misc_feature: GZ8MTXP02IPKOW.38.25.C03.1.454.CMB.2.raw
  modified_base (386)..(386): a, c, t, g, unknown or other
  modified_base (415)..(415): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggaccaaggggctgagtggatgggatggatcagcacttacaatggaaacacaaagtatagcacataatttccaaggcagagtcatcatgaccanagacacatcacgagacacctgccctaaanagtacgaaactgaacggaacgtgagatacgtagacgacacgtacttatattagtgtacgacgagaacgaactaaacttcctaacttaactaataacgttaacgacgtataggtaacgtacgtactttag

SEQ ID NO: 436237 - DNA, 529 bp, Homo sapiens
  misc_feature: GZ8MTXP02FUVK3.38.25.C03.1.454.CMB.2.raw
  modified_base (368)..(368): a, c, t, g, unknown or other
  modified_base (371)..(371): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcgagcacttacaatggaaacacaaagtatgacacataatttcaggacngancatcatgaccacagacacatccacgagcactgacctacagtggaaactgaaggaacctgaacgatacgtagacgacacggtacctttaatactttagttgtgcgaagacgaacaaattcctacttacataagttacgactagtggaagtcgtacttta

SEQ ID NO: 436238 - DNA, 579 bp, Homo sapiens
  misc_feature: GZ8MTXP02HQ60K.38.25.C03.1.454.CMB.2.raw
  modified_base (392)..(392): a, c, t, g, unknown or other
  modified_base (400)..(400): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggatgggatggatcagcacttaacaatggaaaaacacaaaagtatgacaacaataaaatttccaaggggcagaagtcaatcaanacacacanacacacacacgagacacacgacaacagagaacgtagaacgaacgtagagatacgtacgaacgaacgaacgtaccttaattaattaagttagtacgacgaagaaacgaaactaaaacttaccttaccttaactaactaacgttaacgaaacgtacgtaggtaacgttacgttactttacg

SEQ ID NO: 436239 - DNA, 540 bp, Homo sapiens
  misc_feature: GZ8MTXP02JBSFF.38.25.C03.1.454.CMB.2.raw
  modified_base (391)..(391): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacttacaataggaaacacaaagtatcgacacattaatttccgagggcagagtcatcatcgaccanagacacactccacgagacactgacctacagtaggaaactgaacggaacctgactagtcagacgacacggtacttatattattgcgtcgagacgaactaacttcctactactataacgttaacgacgtagtaggtaacgtgtacttttag

SEQ ID NO: 436240 - DNA, 549 bp, Homo sapiens
  misc_feature: GZ8MTXP02GYDSV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacttacaatggaaaacacaaagtatcgacactataatttccgagggcaggatcatcatgaccacagacacatccacgagcactgacctaacatacggaaactggaacgaacctgagtactcgtacgaacgaccgacggtaccttaatattagtgtacgagagacaactaaacttccctaccttatataacttacgaacgtagtaggaacgttgtacttttacg

SEQ ID NO: 436241 - DNA, 564 bp, Homo sapiens
  misc_feature: GZ8MTXP02IRYFW.38.25.C03.1.454.CMB.2.raw
tcagtcgatcacgtcacgaccggtgctcgatttagtagtgtagatttgggtttggggacccaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacacttttagcagttatggtgtcagctggggtgcgacaggcccctggacaagggcttgagtggatgggatggatcagcacttacaatggaaaacacaaaagtatcgacacataatttccagggtcagagtcatcatgaccacagacacatccacgagacactgcctaacatggaaactgaaggaacctgagatcgtagacgacacggtaccttattaacttattcggttgacgtaaggaacgtaactaaaactttccctaacctttacaattaagttaaccgaacgtaagtagggtaaacgttggtactttttaacg

SEQ ID NO: 436242 - DNA, 725 bp, Homo sapiens
  misc_feature: GZ8MTXP02HEEQG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgaggcccctggaccaagggcttgagtggagtgggatggatcagcacttacaagtggaaaacacaaaagtatacgacaactaattaaactttcccgaaggggtccaggtagtacgaaattcaatacgaaccaacaagaacacactacccgaacgacgacctaccgtacgacccttaacgacgttacgggaaaccgttacggaaacgggtaaaccccgttagggaacgtaacgttacccgtaaggaacccggtaaccgtaaccggggtaccccttttaaagttaaccgttttaaagtttcggttaacggtaccggtaaacggtaaacggtaaaaccgttaaaacgttttacccccgttaaccctttaacgtaaactttaacggttaaacccggtaaacggtaacgttaccggggtaaagttacggtttaaccttttttaaacg

SEQ ID NO: 436243 - DNA, 635 bp, Homo sapiens
  misc_feature: GZ8MTXP02FYES5.38.25.C03.1.454.CMB.2.raw
  modified_base (343)..(343): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagcagttatggtgtcagctgggtgcgacaggcccctggacaagggctgagtggatgggatggatcgagcacttacaatggaaaacanaaagtatgacacataattccgaggacagagtcatcatacgacacagacacactaccaacgagacactcgaccctaacagtacggaaacctggaaacgggtaaacccttggaaacgtaacgttaccgtacggaaaccgaaaccgtaacccgggtaaccctttaagttaaactttagttacggtacggacgtaaaggtaaacgtaaacctaaaactttaccccttaaccttaactaaacttaacgtttaaccggaaacgtaacgtacgggtaaagttacggtactttttaaacg

SEQ ID NO: 436244 - DNA, 534 bp, Homo sapiens
  misc_feature: GZ8MTXP02FPD1G.38.25.C03.1.454.CMB.2.raw
  modified_base (504)..(504): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagctgggtgcgacacggcccctggacaagggcttgagtggatgggatggatcagcacttacaataggaaacacaaagtatcgacacaataattccgagggcagagtcatcatgaccacagacacataccacgagacactcgaccctacagtaggaaactggaacgaacctgacgatcgtagacgacgacggtacttatattatgtcgacgagacgaactaacttcctactanataatacgacgagtagaatgtacttttacg

SEQ ID NO: 436245 - DNA, 515 bp, Homo sapiens
  misc_feature: GZ8MTXP02G0AK4.38.25.C03.1.454.CMB.2.raw
  modified_base (385)..(385): a, c, t, g, unknown or other
  modified_base (438)..(438): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggctgagtggatgggatggatcagcacttacaatggaaacacaaaagtatacgacacataatttccagggcagagtcatcatgacanagacacatccagagcactgacctacataggaaactgaaggaacctgagatacngacgacacggcttatattatgtagcgtagagacaaacttcctacttacataagttacgacgataggaatcgacttta

SEQ ID NO: 436246 - DNA, 539 bp, Homo sapiens
  misc_feature: GZ8MTXP02JS8KA.38.25.C03.1.454.CMB.2.raw
  modified_base (311)..(311): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctcctaagttgctcatttacngggcatctaccgggagtcccggggtcctggaccgattcagcggcaggcgggtctgagacagtattcactctcacatcagcagcctgcaggctagaagagtggtggctagtttatacgttgtactagactagtattatagttagtcctacgtacgtacggttttcgggaccggggtaaccacggtcgtaggacgtagtaacgaaacgacgtgtaggcgtacgctaaccg

SEQ ID NO: 436247 - DNA, 537 bp, Homo sapiens
  misc_feature: GZ8MTXP02F32JD.38.25.C03.1.454.CMB.2.raw
  modified_base (411)..(411): a, c, t, g, unknown or other
  modified_base (416)..(416): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctacctaagttgctcatttactgggcatctacccgggagtccggggtcctgaccgattcagcggcaggcgggtctgagacagatttcactctaccacatcagcagccctgcaggctgaaangtagngctagtttattactgttcagtctaagttattaagtagtacgtctactacgtacgttttggggccggggtaccaagtcgtaggagactaacgaaacgtaacgtgtacggctacggactaacc

SEQ ID NO: 436248 - DNA, 594 bp, Homo sapiens
  misc_feature: GZ8MTXP02HX2UN.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggctgagtggagtgggatggatcagctacttacaagtaggaaaacacaaagtatacgacaacataactttccgagggcagagtacatcaatgaaccacagacacatccacgagcactgacctacataggaactggaacggaacctagaacgatacgtaggaaccgactaacgggtaccttaagttaatttaagttggtacgacggtaagaacgtaaactaaaactttccctacctttaacaattaaacgtttaaccggaacgtaacgttaggtaacgttaggttacttttaacg

SEQ ID NO: 436249 - DNA, 520 bp, Homo sapiens
  misc_feature: GZ8MTXP02F670S.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatggggatggatcagcacttacaataggaaacacaaaagtatgacacataatttccagggcagagtcatcatgaccacagacacatccacgagcactgcctacatgaaactgacggaacctgagatcgtagacgacacggacttatattatgtagcgagacgaacaaacttcctactactataacttacgacgatagaagtcgtactttac

SEQ ID NO: 436250 - DNA, 538 bp, Homo sapiens
  misc_feature: GZ8MTXP02JN72P.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctacctaagttgctctatttactgggctatccgtacccgggacgtccggggtccctgaccgacttcgagcggcaggcgggtctgagacagtattcactctcaccatcagcagcctgcaggctagaagatggtggtactagtttattactgtacagtctagtattagtagttacgtctatacgtacgtttcgggccggggactaacgcgtaggagaagtaacgaaaacgtacgtgtcgctacgcctaac

SEQ ID NO: 436251 - DNA, 528 bp, Homo sapiens
  misc_feature: GZ8MTXP02FN722.38.25.C03.1.454.CMB.2.raw
  modified_base (433)..(433): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtacaagcagaaaccaggacagcctcctaagttgctcatttactgggcatctacccggggagtcccggggtcctgaccgacttcagcggcagcggtctgagacagatttcactctcaccatcagcagcctgccagctagaagatagtggctagtttattactgtnagcaagtattatagtagtcctcgtacgtacgttttgggaccgggggacaaacggtcgtaggagataacgaaacgaactggaggctggactaaccg

SEQ ID NO: 436252 - DNA, 693 bp, Homo sapiens
  misc_feature: GZ8MTXP02HTBB4.38.25.C03.1.454.CMB.2.raw
  modified_base (233)..(233): a, c, t, g, unknown or other
  modified_base (275)..(275): a, c, t, g, unknown or other
  modified_base (644)..(644): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctccgngacgacgtcttgttacgtacttagttgagtagtagtgtcagngtcggtggcgacgacgcccgtccgtagaacggacggtcgtaggtaggtaggtagggtaggtagtaggtacgtacgacgaccgttaactaaacgtaaggtaaacgaaaaccaaagtaaagtagtaccgaactaaactaaatttaaccgttaacggaacgaacgtaggtactaactactacgtaagaaccaaaccaacgaacaaaccaactaccaccgaaaggaccactacgacctaacctaagtacggtaaacgaacgtaggaaaccgtacgtaagactacgtagacgaaccgacggtacccgttattaaattacgttagtggtacgacggtaagaaacctaaaacttaaaccctttcccgtaacttaanacgttaaacgtacggaacttacggtaagtacgttcgttttaacttttcg

SEQ ID NO: 436253 - DNA, 504 bp, Homo sapiens
  misc_feature: GZ8MTXP02FU9OE.38.25.C03.1.454.CMB.2.raw
  modified_base (499)..(499): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataatttccagggcagagtcatcatgaccacagacacataccacgagcactgcctacatggaactgagactgagatctgacgacacggcttatacttattgtgcgagagaactaaattcctacttacataattacgacatggaatgntttac

SEQ ID NO: 436254 - DNA, 594 bp, Homo sapiens
  misc_feature: GZ8MTXP02IT98P.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacgaagggcttgagtggagtgggatggatcagcacttacaatggaaaacacaaaagtatagacaacattaaactttccgaaggggacaggagtacaatcatcgaaaccacagacacataccacgagcaactgaccctaacatagggaaacctaggaacggaaccgtaggaagtacgttacgacgaacgaactaacgggtacctttaattaagtttaattggttagacggtaaggacaaactaaacttccctaccttaactagtaacttaaccgacgtagtaggagttacgtacttttacg

SEQ ID NO: 436255 - DNA, 592 bp, Homo sapiens
  misc_feature: GZ8MTXP02FSEGY.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactaccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtgatgggatggatcagcacttacaatggaaacacaaaagtatgacacataatttccaaggtcagagtcatcatagaccacagacacactccaacgagccactcgcctacagtcggaaactggaacggaacctggaagacttacgacgaacgacgaaccgggtccttaataatttaagttggttagaccggaagtaacggtaactaaaactttccctacctttaaacaacggttaatttaaaccgaacggttaacgtacgggtaaacgttaggtacctttttaaacg

SEQ ID NO: 436256 - DNA, 525 bp, Homo sapiens
  misc_feature: GZ8MTXP02IMFCQ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacagggcttgagtggatgggatggatcagcacttacaatggaaaacacaaaagtatgacacataatttccagggcagagtcatcatgaccacagacacatccagagcaactgcctacatggaactagaggaacctgagatctgacacacggcttatattattgtagcgagacgaacaaaacttcctaccttaacataacgttaacgacgtataggtaacgtgtacttttaac

SEQ ID NO: 436257 - DNA, 626 bp, Homo sapiens
  misc_feature: GZ8MTXP02JY1FG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacaagggcttgaggtggagtgggatggatcagctacttacaataggaaaacaacgaaaagtatcgacaactaattaaactttccgaaggggtcaggacgtacatcatcgaaaccacgacgacaacactaccacgacgacactcgacctaacagtacggaacgtaggaacggaaccgtgaagtactacgtacggaaccgaccgaccggtacctttattaacgtttagttcgtacggacgaaggtaaacgtaactaaaactttccctaccttaactaacgttaacgttaaccggaaacgtacgtaggtaacgtttacgtactttttaacg

SEQ ID NO: 436258 - DNA, 600 bp, Homo sapiens
  misc_feature: GZ8MTXP02IS4ZH.38.25.C03.1.454.CMB.2.raw
  modified_base (421)..(421): a, c, t, g, unknown or other
  modified_base (561)..(561): a, c, t, g, unknown or other
  modified_base (590)..(590): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacgacggcccctggacgaagggtcttggagtggagtgggatggatcagctaacttacaataggaaaacacgaaaaggtatacgacaacaattaaatttaccgaaggggacaggagtacaattaccaatcgaaaccanaacgactaacataccaacgacactactagacccttaacgagttacgggaaacttaggaacgaaccgttagaagtatcgacgaccgaacgacggtaccttatattatggtagacgtagacaactaacttacctaccttaanacttaagttacgacgtactaggtaacgtnttacttttac

SEQ ID NO: 436259 - DNA, 546 bp, Homo sapiens
  misc_feature: GZ8MTXP02GH1I2.38.25.C03.1.454.CMB.2.raw
  modified_base (420)..(420): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacaagggcttgagtggatgggatggatcagcacttacaagtaggaaacacaaaagtatcgacactataatttccgagggcagagtcatcatcgaccacagacacactaccacgagcactgacctanagtaggaactgaagaacctgacgtatacgtagacgacacggtaccttattattattgtagacgagacgtaactaaacttcctaccttacaactaagttacgacgtagtaggtaacgtgtactttta

SEQ ID NO: 436260 - DNA, 587 bp, Homo sapiens
  misc_feature: GZ8MTXP02G5FDU.38.25.C03.1.454.CMB.2.raw
  modified_base (315)..(315): a, c, t, g, unknown or other
  modified_base (341)..(341): a, c, t, g, unknown or other
  modified_base (366)..(366): a, c, t, g, unknown or other
  modified_base (402)..(402): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataaagaattactcgcttggtaccagcagaaaccaggacagcctcctaaagttgctcatttacgnggcactccgtaccggcgtccggtccncgacgtactcgagcgcaggcggtcngagacagtacttcactcacacagtacacgacacgcncgacgacgacgtagagtagtagtagtacgtagtttattacgtacgtacgacgtacgtaagttaagttaagttacgtacgtacgtacgtacgttacggtttacgggtaccgggtaaccggtaacgtacgtacggtaacgtaacgtaacgtaaacgtaacgtacggtacggtacgtacgtacgtacg

SEQ ID NO: 436261 - DNA, 513 bp, Homo sapiens
  misc_feature: GZ8MTXP02HTWRP.38.25.C03.1.454.CMB.2.raw
  modified_base (342)..(342): a, c, t, g, unknown or other
  modified_base (434)..(434): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggagcctcagtgaacgtctcctgcaaggcttctggttacacttttagcagttatggtgtcagctgggtgcgacaggcccctggacaagggcttgagtggatggggatggatcagcacttacaatggaaaacncaaagtatgacacataatttccagggcagagtcatcatgaccacagacacatccacgagcactgcctacatggaactgaggacctgagatcngacgacacggaccttagtattatgttgcgaagagaactaaattcctaccttacaatacttacgacagtcggaatcgtac

SEQ ID NO: 436262 - DNA, 510 bp, Homo sapiens
  misc_feature: GZ8MTXP02FSX1K.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataattccgagggcagatcatcatgaccacagacacatccagagcactgacctacagtggaaactgacgaacctgacgatctgacgacgacgcttaatattagtgtagcgagagactaaacttcctactacataatacgagtataggaatgacttta

SEQ ID NO: 436263 - DNA, 687 bp, Homo sapiens
  misc_feature: GZ8MTXP02G0ZFL.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggaccgagggcttgagtggagtgggatggatcgagcacttaacaagtacggaaaacaacaaaagtatacgacaacgtaattaaactttccgaagggcagagttacaagtacaatacggaacccaaacaacgaaccaactaactacccgaacggaacgacaaccgtcgacccttaacacgttaacgggaaaccgttagggaaaccggtaacccgttaggaacggtaaacgtccgttaacggaaacccggaaccgtaaccgggtaccctttaagttaacgtttagttacggttagaccggtaaaggtaaacgtaaaccttaaaacgtttcccttaacctttaactaacttaacgttaacgacgtaacgtaggtaagttacgttactttttaacg

SEQ ID NO: 436264 - DNA, 520 bp, Homo sapiens
  misc_feature: GZ8MTXP02GSBK8.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactccccaggttcaattggtgcagtctggagctgcggtgaagaggcctggggcctcagtgaacgtctcctgcaaggcttctggttacactttttagcagttatggtgtcagctgggtgcgacaggccccctggacaaggggcttgagtggatgggatggatcagcacttacaatggaaaacacaaaagtatgcacataatttccagggcagagtcatcatgaccacagacacatccacgagcactgcctacatgaactgagacctgagatcgtgacgacacggccttatactattgtgcgtagacgacaaacttcctacttaacataattacgacgtatggaaacgtgtacttttag

SEQ ID NO: 436265 - DNA, 523 bp, Homo sapiens
  misc_feature: GZ8MTXP02J0MFI.38.25.C03.1.454.CMB.2.raw
  modified_base (370)..(370): a, c, t, g, unknown or other
  modified_base (411)..(411): a, c, t, g, unknown or other
  modified_base (436)..(436): a, c, t, g, unknown or other
  modified_base (462)..(462): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaaacacaaaagtatcgcacataatttccagggcngagtcatcatgaccacagacacatcacgagcactgacctanatggaactgacgaacctgagatcgngacgacacggccttatatatgtacgngagacgtaacaaacttccacttaacataacgttacgacgtactaggaacgtgtacttttag

SEQ ID NO: 436266 - DNA, 791 bp, Homo sapiens
  misc_feature: GZ8MTXP02JLX7D.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtcctcgtcgacgacgtcttcggttacgttacttacgtttacgacgttaagttaggtggttcgtacgacggtcggttggggtcggaccgacggaccccggtcccggtaggaacgggtacggttcgtaggtagggtaggtagggtagggtaggtagggtactacggacgtacctttaaccgtaaacgtaaggtaaacggaaaaccaaaacgtaaaagtagtaccgaacctaacgttaaactttaaccgttacggggacggacgtacgggtacgtaacgtactacgtacggtaccgaaacccaacggaaccaacaacccttaacccgtacccggaaacggacctacccgtaccggtacccgtaacccctaaagtacgggttaaccggaaacgtaacggggaaacccgttaccggtaaggaacgtccttacggaaccgaaccgtaaccgtaccggtttactttaaagttacgtttagcggtacgaggaaagtaacctaaacttaccttcccttaactaactaagttaacgtaacgtaacgtaggtacgtaacgttcgttaacttttcgg

SEQ ID NO: 436267 - DNA, 556 bp, Homo sapiens
  misc_feature: GZ8MTXP02JWMR6.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtcctgaccgatcagcgcagcggtctgagacagattcactctcaccatcagcagccctgcaggctagagatgtggactagtttatactgtacagcagttattatagtacgtcctactacgttacgtttcggggacccgggggtaaccaaacggtccgttagggacgtaacgttaaccgaaaacggtaaccgttggtacgggaccttacggacctaaacccg

SEQ ID NO: 436268 - DNA, 731 bp, Homo sapiens
  misc_feature: GZ8MTXP02FN1TX.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacgacggcccctggacgagggcttgagtggagtgggatggatcagctacttacaagtaggaaaacagaaaagtatacgacaactaattaaacgtttacccgaaggggactagggacgttaccaattacaagtacggaaacccaaacgaacgaaccaaaccactacccgaaacgaacggacccaaccgtacggtaaccccttaaacgaaacgtacgggtaaaaccgttacgggaaacgggtaaaacccttaggaacgtaacgttacgtaacggaaccggaaccgtaccggggttaacctttaagttaacgttttagttacggttaggtaccggaaagtaaacggtaaaaccttaaactttaccccgttaaacccttaattaaacttaaacgttaaaccggtaacgtaacggttacggtaaaaggtttcgttacttttttaaaccgg

SEQ ID NO: 436269 - DNA, 524 bp, Homo sapiens
  misc_feature: GZ8MTXP02IM1O1.38.25.C03.1.454.CMB.2.raw
  modified_base (410)..(410): a, c, t, g, unknown or other
  modified_base (434)..(434): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaaagtatcgacacataattccagggcagagtcatcatgacacagacacatccacgagcactgacctanatggaactgaacgaactgagatcngacgacacgaccttatattatgtagacgtagacgtaactaaattccctacttacaattaagttaacgacgtataggaagttgtactttta

SEQ ID NO: 436270 - DNA, 633 bp, Homo sapiens
  misc_feature: GZ8MTXP02IIR1L.38.25.C03.1.454.CMB.2.raw
  modified_base (317)..(317): a, c, t, g, unknown or other
  modified_base (369)..(369): a, c, t, g, unknown or other
  modified_base (376)..(376): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagttgttttacacaggtaccaaacaataagaattactcgcttggtaccagcaagaaaccaggacagcctctaagttgctcatttacngggactatcgtacccgggagtcccggggtccctgaccgtacttcgagcggcngcggtcngagacagtattccactctacacctatacagcacgcctgcgaggcgtacgaagtagtggttcggtacttaagtttttaagttaccgttggtaccgtagtaccgtaagtttaagtttaacgtaagttacgttacccttacgttacggttaacggtttttccgggggacccgggggtaaccgtaacggtacccgttaggggaacgtaacgtaaccgtaaaaccggaacgttcggtacggtccgtacggtaccctaacccg

SEQ ID NO: 436271 - DNA, 785 bp, Homo sapiens
  misc_feature: GZ8MTXP02F85RY.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggcttgagtggagtgggatggatcagcacttacaagtaggaaaacacgaaagtatcgacactaattaaactttccgaaggggtacaggacgtacaagttaccaagttacgaacccaaacgaaacgaaccaaaccgaactacccgaacggaacgacctaaccgtcggtacccttaacgagttaacgggaaaccttacgggaaacgggtaaacccgttaggaaaggtaacgtttaccgtaacggaaacccggtaaaccgtaacccggggttaaccctttaaatttaaacgttttaacgtttacgggttacggaacccgggtaaaagggtaaaccggtaaaaccgttaaaaaccgtttttacccccgtttaaaccgttttaaaacccgttaaagtttaaaacccggttttaaaacccggaaaaccgggttaaaacggttaacgggggtttaaaaacggtttccggtttaaccgttttttttaaaaccg

SEQ ID NO: 436272 - DNA, 507 bp, Homo sapiens
  misc_feature: GZ8MTXP02JEFQO.38.25.C03.1.454.CMB.2.raw
  modified_base (382)..(382): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataattccagggcagagtcatcatgaccanagacacataccacgagcactcgacctacatggaaactgaaggacctgagatcagacgacacggacttatatatgtgcgagacacaaacttctactacataattacgacgataggaatgtctttaa

SEQ ID NO: 436273 - DNA, 717 bp, Homo sapiens
  misc_feature: GZ8MTXP02GPJXM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacagggcttgagtggatgggatggatcagcacttacaataggaaaacacaaaagtatacgacacaattaaactttccgaaggggtcaggagttacaattaccaatacgaaacccaacaagaaccaacaactacccgaacgaacgaccaaccttcggaccccttaaacgaacttacggggaaaaccttacggaaacgggtaaaaccccgttggaaacggtaacttaccgtaacgggaaaccggtaaaccgaaccggggtacccttttaaaggttaatttaaacgtttggttacggtaccgggtaaaggaaaccggtaaacctaaaaacgttttccccgttaaccctttaaacctaaatttaaacgtttaaacccggaaacggtaaacgttacggggtaaaagtttcggttaaccttttttaaacg

SEQ ID NO: 436274 - DNA, 543 bp, Homo sapiens
  misc_feature: GZ8MTXP02F230O.38.25.C03.1.454.CMB.2.raw
  modified_base (416)..(416): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaaccaggacagcctacctaagttgctcatttactgggcatcgtacccggggagtcccggggtccctggaccgattcgagcggcaggcgggtctgagacagtatttcactctcaccatcagcagcctgcagctagaagntgtggactagtttatactgtacagctagtattagtagtactctacgtacgttacgtttggggaccggggtaccaagtcgtaggacgtataaccgaaaacgtaacgtggtacgtactacgactaaccg

SEQ ID NO: 436275 - DNA, 555 bp, Homo sapiens
  misc_feature: GZ8MTXP02FKSUD.38.25.C03.1.454.CMB.2.raw
  modified_base (403)..(403): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaaggggcttgagtggatgggatggatcagcacttacaatggaaaacacaaaagtatgacacaataaatttccaagggcagagtcatacatgaccacagacacatccanagcactgacctacatggaaactgaggaaacctgagatctagacgacacggtccttaataattagttgttaggcgaagggaaacaaactaaacgttacctaccttaactaattaacgttaacgaacgtagtaggtaacgtcgttactttaacg

SEQ ID NO: 436276 - DNA, 616 bp, Homo sapiens
  misc_feature: GZ8MTXP02F0COD.38.25.C03.1.454.CMB.2.raw
  modified_base (354)..(354): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgaaaacaggtcttctggttactacttttagctagttatggtgtcagcgtgggtgcgacaggcccctggacaagggcttgaggtggatgggatggatcagcacttacaagtaggaaaacanaaagtatacgacacgaataactttccaaggaacaggagtacataccatcgaaccaacaagaacacactaccaacgacgaccactcgaccctaacaagtacgggaaacctaggaaacggtaaacccgtgaacgtatacgtacgaacgacgtaccggtacttaatattagttgtagacgtaagacgaaactaaactttaccttaccttaactaaattaagtttaaccgaacgtaacgtaggtaaacgtagttactttttaaacg

SEQ ID NO: 436277 - DNA, 553 bp, Homo sapiens
  misc_feature: GZ8MTXP02JYT2V.38.25.C03.1.454.CMB.2.raw
  modified_base (410)..(410): a, c, t, g, unknown or other
  modified_base (516)..(516): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacaagggcttgagtggatgggatggatcagcacttacaatggaaaacacaaaagtatacgacacaattaaactttccgaagggcagagtcatcatgaccacagaacacatccaagngcaactcgacctacagtacggaaactggaacgaactgagatctagaccgaacacggtccttagtactagttagtcgacgagaacgactaaacttcctacccttaanaataacgttaacgacgtataggaacgttgtactttag

SEQ ID NO: 436278 - DNA, 670 bp, Homo sapiens
  misc_feature: GZ8MTXP02HB9O3.38.25.C03.1.454.CMB.2.raw
  modified_base (351)..(351): a, c, t, g, unknown or other
  modified_base (357)..(357): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcgagcacttacaatggaaaacacaaaagtanacacanataacttcgaggacagatacatacatacgaaccaacaacgaacaacaactaccgaacgaacgaccacctacgaccctaacgacgtaacggaaacgtacggaaacggtaaaccgtaggaacgtacgtaccgtaacggaaaccgaaccgtaaccggttacctttaaattaacgtttaagttacggtacggtaacggaaacggtaaacctaaaacctttaaaactttacccgttaacctttaaacttaaacgtttaaaccgttaaacggtaaacggtaacggttaacggtaacggtttacgtttaacgttttaacg

SEQ ID NO: 436279 - DNA, 551 bp, Homo sapiens
  misc_feature: GZ8MTXP02GV614.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgagtggagtgggatggatcagcacttacaataggaaacacaaagtatgacacataatttccgagggcagagtcatcatcgaccacaagacacactaccacgagcactcgacctaacgatggaaactggaacggaacctgacgatcgagacgacacggtaccttaatattagttgtagacgtagacgaactaaacttccctaccttaacattaagttaccgacgtagtaggaacgttgtacttttag

SEQ ID NO: 436280 - DNA, 549 bp, Homo sapiens
  misc_feature: GZ8MTXP02GK7BA.38.25.C03.1.454.CMB.2.raw
  modified_base (403)..(403): a, c, t, g, unknown or other
  modified_base (411)..(411): a, c, t, g, unknown or other
  modified_base (421)..(421): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaaacacaaaagtatgacacataattccagggcagagtcatcatgacacagacacatccagagcactnaccctaanagtacgaacnggaacgactgagatacgacgacgacgacgtacttaattattagttgtacgacgaagaacgaaactaaactttcctaccttaactagttaacgttaacgaacgtagtaggtaagttacgttactttaag

SEQ ID NO: 436281 - DNA, 554 bp, Homo sapiens
  misc_feature: GZ8MTXP02JXMUB.38.25.C03.1.454.CMB.2.raw
  modified_base (423)..(423): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacaagggcttgagtggatgggatggatcagcacttacaataggaaaacacgaaaagtatacgacaacattaatttccgaggggcagacgtacatcatgaccacagacacatccagagcactgaccctanatacggaactgaaggaacctgagatacgagacgacgtacggtccttattacttattggtacgacggagaacgaactaaacttccctacttaacaataacgttacgacgtagtaggacgttcgacttttaag

SEQ ID NO: 436282 - DNA, 584 bp, Homo sapiens
  misc_feature: GZ8MTXP02H46EN.38.25.C03.1.454.CMB.2.raw
  modified_base (410)..(410): a, c, t, g, unknown or other
  modified_base (468)..(468): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacgacggccccctaggacgaagggcttggaggtggagtgggatggatcgagcacttacaagtaggaaaacacgaaagtatgacaactataactttccgaagggcagacgtcatacatcgaccaanacgacacactaccaacgacgccaactcgacctaacgatacggactagacgaactgaanatacgagaacgacgacgtacttagtattaacgtgtacgacgagaacgtaaactaacttcccttactactaattaacgttaaacgacgtacgtaggtaaacgttcgttacttttacg

SEQ ID NO: 436283 - DNA, 586 bp, Homo sapiens
  misc_feature: GZ8MTXP02HI18J.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttggagtggagtgggatggatcgagcacttacaagtaggaaaacacaaaagtatacgacaactaattaaactttccgaaggggacaggtagtcaattccgaagtcgaaacccacaacgaccaaacactacccgaacgacgaccactcgaccctaacagtaggaaactaggaacgaaccgtagacgagtctagacgacacggtacttatacttatgtacgacgagacgaactaaacttcctacttacattaacgttacgaacgtagtaggagttcgtacttttag

SEQ ID NO: 436284 - DNA, 608 bp, Homo sapiens
  misc_feature: GZ8MTXP02GAWBH.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacgaagggcttgagtggagtgggatggatcagcacttacaagtaggaaaacaacgaaaagtatacgacaactaattaaactttccgaagggtacaggtacgtacaatacatacgaaccaacaacgacaacactaccgaacgacacactacgacctaagagtacggaaactggaaacgaaccgtagacgtagtacgacgaacgacgtacggtaccttagtaagtttattgtagacgaagaacgtaaactaaacttcctaacttaactaataacgttaacgaacgtagtaggtaagttcgttacttttaacg

SEQ ID NO: 436285 - DNA, 597 bp, Homo sapiens
  misc_feature: GZ8MTXP02H5K2T.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggatgggatggatcagcacttacaataggaaaacacaaaagtatacgacaacattaatttccagggtcagagtcatacatgaccaacagacacatccacgagcactgacctacagtcggaaactacggaaggtaaccctggaacgtacgtacgtacgaaccgaacgtaccgggtacctttaattaagtttacgttgttacggacgtaagaacggtaaactaaactttccctacctttaacaacgttaagttacgaacgtagtaacggaagtttcggtactttttaacg

SEQ ID NO: 436286 - DNA, 522 bp, Homo sapiens
  misc_feature: GZ8MTXP02HB1KI.38.25.C03.1.454.CMB.2.raw
  modified_base (372)..(372): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatagacacataatttccggggacagngtcatcatgacacagacacatccacgagcactcgactacataggaactgaggaacctgagatcgtagacgacgacggcttatattatgtgacgagagactaaattcctacttacattaactaacgagagtacgaagtgtactttatttcg

SEQ ID NO: 436287 - DNA, 561 bp, Homo sapiens
  misc_feature: GZ8MTXP02GB1XT.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacaggcccctggacaagggctgagtggatgggatggatcgagcacttacaagtaggaaacacaaagtatgacacataactttccgagggtcagagtcatcatgaaccacagacacactccaacgagcactcgacctacagtacggaactaggaacggaacctgaacgtagtctacgacgtaccgacggtaccttatagttagttagtcggacgaagacgtaaactaacttcctaccttacattaacgtacgaacgtataggaattcgtacttttaag

SEQ ID NO: 436288 - DNA, 614 bp, Homo sapiens
  misc_feature: GZ8MTXP02GWEKK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgagggcttggagtggagtgggatggatcagcacttacaataggaaaacacaaaagtatacgacaacaattaaatttaccgaaggggacaggagtcaatcatacgaaccacagaacacactaccaacgacgacactcgacccttaacacgtacggaaactacggaaacggaaccttaggaacgtactacgtaacgaaccgacgtaacggtacctttaagtacttaattgtacggtacgaaggtacgtaaactaaacttcctaaccttaacaattaaacgttacgaacgtaagtcggaaaagttcgttaacttttacg

SEQ ID NO: 436289 - DNA, 532 bp, Homo sapiens
  misc_feature: GZ8MTXP02JDDEZ.38.25.C03.1.454.CMB.2.raw
  modified_base (383)..(383): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgcacataatttccagggcagagtcatcatgaccanagacacatccacgagcactgcctacatgaactgaacggaacctgagatcagacgacacggacttatattattgtgacgagacgaactaaacgttcctaccttactaataactttaacgaacgtacgtaggtaacgttagtacttttaac

SEQ ID NO: 436290 - DNA, 690 bp, Homo sapiens
  misc_feature: GZ8MTXP02GV8OA.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacgaagggcttgagtggagtgggatggatcgagcacttacaatggaaacacgaaagtatcgacactataactttccgaagggacaggacgtcatcatacgaccacagacacgactccgaacgacgacactcgacctacagtacggaaactaggaaacggtaaccgttagaacgtacttacgacggaaaccgaccgtaccgggtacctttaagttaactttagttacggtacggtaccggtaaagtaaaccggtaaaaccttaaaaccgttttcccccgtttaaccctttaaaccttaaacgtttaaaaccgtttaaaacccgggtaaaaccggttaaaggttaaccgggggttaaaaacgttttccgggtttaaacgttttttttttaaaccccg

SEQ ID NO: 436291 - DNA, 563 bp, Homo sapiens
  misc_feature: GZ8MTXP02I8AAU.38.25.C03.1.454.CMB.2.raw
  modified_base (404)..(404): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctacctaagttgctcatttactgggcagtccgtacccgggagtcccggggtccctggaccgattcgagcggcacggcgggtctggagacagtactttcactctcaccatcancagcctgcgagctagagatggtgtctagtttattactgtacagtcagtattatagtacgtcctacgtacgtacgtttcgggaccggggtaaccgtaacggtcgtagggtacgtaacgtaaccgaaaacgtaacgtacggtacggtacgtcgactaaccg

SEQ ID NO: 436292 - DNA, 671 bp, Homo sapiens
  misc_feature: GZ8MTXP02JMS8T.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggcccctggacgaagggtctggaggtggagtgggatggatcgagctacttacaataggaaaacacaaagtatacgacactaattaactttccgaaggggcaggagtacaagttacagtacgaaccaacgaacgaacaacactacccaacgaacgacaccgtcgaccctaacagttacgggaaactaggaaacggtaaaccctaggaacgtacgtaccgtacggaacccgaaccgtaccgggtacctttaagttaagtttacgttaggtacggtacgaaggtaaacggtaaaccttaaaacctttcccttaacctttaactaacgttaacgttaaaccggtaacggtaacgttagggtaaacgttacgtttacgtttttaacg

SEQ ID NO: 436293 - DNA, 602 bp, Homo sapiens
  misc_feature: GZ8MTXP02FT1T1.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgacggcccctggaccgaagggcttggagtggagtgggatggatcagcacttacaagtaggaaaacacaaaaggtatcgacaacaattaactttccgaaggggacaggagtcaattaccaatacgaaccaacaagaccaacactacccaagacgacactcgacctaacgaagtacggaaacgtaggaacggaaacccgtgaacgattacgacgaccgacgtacggtaccttattattagttgtagacgaagtacaaacttaacttacctaccttaataacttaacttacgacgtacgtaggtaacgtgtacttttacg

SEQ ID NO: 436294 - DNA, 546 bp, Homo sapiens
  misc_feature: GZ8MTXP02JU6PR.38.25.C03.1.454.CMB.2.raw
  modified_base (353)..(353): a, c, t, g, unknown or other
  modified_base (513)..(513): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgaggtggagtgggatggatcgagcacttacaataggaaacacaaagtntagcacataacttcagggcagagtcatcatcgaccacagacacactaccacgagcactcgacctacagtacgaaacgtgaaacggacctagagactcgtacgacgacgacggtaccttagttatttagtgtagacgagacgtaacaaacttcctacttanataagtacgacgtagtaggaacgtgtactttag

SEQ ID NO: 436295 - DNA, 531 bp, Homo sapiens
  misc_feature: GZ8MTXP02F0WFD.38.25.C03.1.454.CMB.2.raw
  modified_base (413)..(413): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaagtaggaaacacaaagtatgacacataatttccagggcagagtcatcatcgacacagacacatccacgagcactgcctanatgaactgacgaacctgagactcgtagacgacacggtacctatattaagtgtagacgtagacgactaaacttcctaccttacaagttaattacgacgtataggaagtcgtacttttaa

SEQ ID NO: 436296 - DNA, 556 bp, Homo sapiens
  misc_feature: GZ8MTXP02I0XIP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaaacacaaaagtatagacacaataaatttccaaggggtacagagtacaataccaatcgaaccaacaacgaacaacatacccaacgagaccactcgacctaacataggaaactgaaggaacctgagatctagacgacacggccttaatattatgtgacgagacgaacaaacttcctaccttaacataacgttacgaacgtataggaatacgacttttaag

SEQ ID NO: 436297 - DNA, 532 bp, Homo sapiens
  misc_feature: GZ8MTXP02JM6J0.38.25.C03.1.454.CMB.2.raw
  modified_base (313)..(313): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctacctaagttgctcatttacngggcatcgtaccgggagtcccggggtcctgaccgactcagcgcaggcgggtctgagacagtattcactctcaccatcagcagcctgccaggctagaagatgtggactagtttatactgtcagctagtattatagtagtctcgtacgtacgtttcggggccggggacaaacggtcgtacggagagtaacgaaaacgtaacgtggtaggctacgactaacc

SEQ ID NO: 436298 - DNA, 626 bp, Homo sapiens
  misc_feature: GZ8MTXP02JQRHI.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacaagggcttggaggtggagtgggatggatcgagcacttacaagtggaaaacacaaagtatacgacaactattaactttccgaaggggacaggacgttacaatcaatacgaacccaacacgaaccacaactaccgaacgaacgacacctcgaccctaacagttacggaaactaggaacggaaaccctggaacggtactcgtagaccgaccgacggtacctttaagttagtttagttcggtagacggtaagaacgtaacctaaacttttccctaacctttaacaacttaacgttaacgaacgtacgtaggtaacgttcgtactttttaacg

SEQ ID NO: 436299 - DNA, 775 bp, Homo sapiens
  misc_feature: GZ8MTXP02F7YLN.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctggacgaagggcttggaggtggagtgggatggatcgagcaacttacaagtaggaaaacaacgtaaaagtatacgaccaacgtaatttaaactttacccgaaggggtaccagggtacgtacaacttaccgaatacggaaacccaacaaacgaacccaaaccaactacccgaaacgacgacccaacgttacggaccccttagaaacgttacgggaaaaccttacgggaaacgggtaaaacccttggaaacggtaactttacccgaacggaaacccggtaaccggtaaacccgggttaaccctttaaatttaacgttttaaacgtttgggttaccggtaagggaaacggttaaacggtaaaacccgtttaaaaccgtttttaccccgtttaaacctttaaacctaaagtttaaaccgtttaaaccggaaaccggttaaacgttacggggtaaaacgtttcggtttaaccctttttttaacg

SEQ ID NO: 436300 - DNA, 581 bp, Homo sapiens
  misc_feature: GZ8MTXP02ICXX9.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctgtttactacttttagcagttatggtgtcagcgtggtgcgacacggcccctggacaagggtcttggagtggagtgggatggatcagcacttacataggaaacacaaaagtatcgacaactataaactttccgagggcagagtcatcatacgacacacgacacactccacgagcactgacctacatggaaactgaacggaactgacgatcgtagaccgacgaccggtacctttattaagttacttggtacgacgtaggaacgtaaactaaaactttccctactttaacaacgttaagttaacccggaacgtaagttacggtaaagttcgttacctttttag

SEQ ID NO: 436301 - DNA, 565 bp, Homo sapiens
  misc_feature: GZ8MTXP02IAC0J.38.25.C03.1.454.CMB.2.raw
  modified_base (525)..(525): a, c, t, g, unknown or other
tcagtcgatcacgtcacgaccggtgctcgatttagtagtgtagatttgggtttggggacccaaaaaccacacccctcccttgggagaatcccctagatcacagctcctcaccatggactggacctggagcatccttttcttggtggcagcagcaacaggtgcccactcccaggttcaattggtgcagtctggagctgcggtgaagagggcctggggcctcagtgaacgtctcctgcaaggcttctggttactacttttagcagttatggtgtcagctgggtgcgacagggcccctggacaagggcttgagtggagtgggatggatcagcacttacaatggaaaacaacaaagtatcgacaactataactttcgaagggcagagtcatcatcgaacacacgacactacaccaacgacgacaactcgacctaacatacggaaacctgaacgggaacctagagatactgaaccacgacggtcttaatatttagtgtcgagtagaactaactaaacttcctaccttaanattaacttaacgacgtataggtaagtacgttactttaacg

SEQ ID NO: 436302 - DNA, 635 bp, Homo sapiens
  misc_feature: GZ8MTXP02GAVV2.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgaagggcttgagtggagtgggatggatcgagcacttaacaagtacggaaaacacaaaagtatacgacaactaattaaactttccgaaggggtacaggagtacaatcaatacgaaccaacaagacaacactaccgaacgaacgaccaactcgaccctaacgacgtacggaaactaggaaacggaaaccctaggaacgtaacgttacgaacggaaccgaacgtaccggtacctttaagtactttagtggtacgacggtaaagaacgtaaactaaacttcccttaacttacctaataacgttaaccgaacgtaacgtaggtaagtacgtactttttaacg

SEQ ID NO: 436303 - DNA, 536 bp, Homo sapiens
  misc_feature: GZ8MTXP02F4FKF.38.25.C03.1.454.CMB.2.raw
  modified_base (370)..(370): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaagtggaaacacaaagtatgacacataatttccagggcngagtcatcatgacacagacacactccacgagacactcgacctaacagtaggaaactggaacggaacctgaagatctacgacgacacggtaccttaatacttagtcgtcgacgagaacgtacaaacttcctacttaacataataacgatacgtggaatcgtacttta

SEQ ID NO: 436304 - DNA, 680 bp, Homo sapiens
  misc_feature: GZ8MTXP02G7KW8.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacaagggcttgagtggagtgggatggatcgagcacttacaagtaggaaaacaacaaagtatacgacaactaattaactttccgaaggggcaggtagtacaattacatacgaacccaacaacgaaccaaccactacccgaacgacgaccaacctcgaccctaacgacgttacgggaaaccgttaggaaacggtaaacccgttggaaacgtacgttaccgacggaaaccgaaccgtaaccgggttacctttaagttaaacgtttagttaggtacgaccggtaaaggaaacggtaaacctaaaacctttccctaaacccttaactaaacttaacgtttaaccggaacggttaacgttagggtaaaacgttcggttactttttaacg

SEQ ID NO: 436305 - DNA, 567 bp, Homo sapiens
  misc_feature: GZ8MTXP02G4CNE.38.25.C03.1.454.CMB.2.raw
  modified_base (359)..(359): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggaccaagggcttggagtggatgggatggatcagcacttacaataggaaaacacaaagtatcgacanaataactttccgagggtcagtacgtcatacatacgaccacaacgacaacactaccgaacgacgacactcgaccctacagtaggaaactggaacggaacctgagatctagacgacgacgtcttaatattagtgtagacgtaagacgtaaactaaacttccctaccttaataataacgttacgaacgtataggaagttcgtacttttacg

SEQ ID NO: 436306 - DNA, 776 bp, Homo sapiens
  misc_feature: GZ8MTXP02IXDH8.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtctgggtgcgacacggcccctggacaagggcttgagtggagtgggatggatcagctacttacgaataggaaaacacgaaaagtatcgacaacgtaattaacgtttccgaaggggtccagggtacgttaccaattaccgaagtacggaaacccaacgaaacgaaccaaccaactaacccgaacggaacgacctaccgtacggaaccctaacgtaagttacggaaaccgttagggaaaccgggtaaacccgttaggaacgtaacggttaaccgtacggaacccggtaaaccgtaccgggttaaaccctttaattaacgtttaagtttacggggttaacggaaccggtaaaaggtaaaaccggttaaaacccgttaaaaaccgttttcccccgtttaaaacccgtttaaacccgttaaaatttaaaaccggtttaacccggtaaaccggttaaaaggttaacgggtttaaaacggtttacgtttaacggttttttttaaacccg

SEQ ID NO: 436307 - DNA, 718 bp, Homo sapiens
  misc_feature: GZ8MTXP02HAZ3X.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacgaagggcttgagtggagtgggatggatcagcacttacaagtcggaaaacacaaaagtatcgacaacataatttccgaagggcagagtcatcatcgaaccacagacaacactacccaagacgaccactcgacccttaaacacgtacgggaaaaccgttagggaaaccgggtaaacccttaggaacggtaactttaccgtaacggaacccggtaaaccgtaaccggggtttaacccttttaaagttaacttttaaacggttggttacgggtacccgggaaaggtaaaccgggtaaaacccttaaaaacgttttacccccgttaaccgtttaaacccgtaaatttaaaaccggttaacccggtaaaacggttaacggttaaccggggtaaaacggtttaccgggttaacttttttttaaaccgg

SEQ ID NO: 436308 - DNA, 749 bp, Homo sapiens
  misc_feature: GZ8MTXP02GYMEG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgagggtcttggagtggatgggatggatcgagcaacttacgaagtaggaaaacacgaaagtatagaccaactaattaacgtttacccgaaggggtaccagggacgttacaacgttacaagtacggaaacccaacgaaacgaaaccaaccgaaactaccccgaaacggaacgacccaacgttaccgaacccttaacaacgttacgggaaaaccgtggaaaacgggaacccttaagggaagtaacgttaccgtaacggaaaccggaaccgtaaccgggttaacccttttaaagttaaactttaagtttcggttacggtaacggaaaggtaaccggtaaaaccgttaaaaccgtttttcccgtaaaccctttaaacctaaatttaacgtttaaaccggaaaccggttaaacgttacgggggttaaaacgtttcggtttaacccttttttaaacgg

SEQ ID NO: 436309 - DNA, 585 bp, Homo sapiens
  misc_feature: GZ8MTXP02HJE0T.38.25.C03.1.454.CMB.2.raw
  modified_base (460)..(460): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacaaggacttgagtggatgggatggatcagcacttacaataggaaaacacaaaagtatcgacactaattaaagtttccgaaggggtcaggacgtacatcatacgaaccacagacacataccacgagcactcgacctaacatacggaaactgaaacgacctaganactacgtagacgacgacggtacttaatattagttgtagacgtaaggaactaaactaaaactttcctaaccttaactaattaaacgttacggaacgtagtacggtaacgttagtacctttttaacg

SEQ ID NO: 436310 - DNA, 514 bp, Homo sapiens
  misc_feature: GZ8MTXP02GVMDO.38.25.C03.1.454.CMB.2.raw
  modified_base (466)..(466): a, c, t, g, unknown or other
  modified_base (484)..(484): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggatgggatggatcagcacttacaatggaaacacaaagtatgacacataatttccgaggtcagagtcatcatgaccacagacacatccagagcacctgacctaacatggaaactgaagacctgagatctagacgacacggccttatattatgtgcganagacaaattcctacctanataattacgacgtataggactgtactttac

SEQ ID NO: 436311 - DNA, 768 bp, Homo sapiens
  misc_feature: GZ8MTXP02GLGTI.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgagtggatgggatggatcagcaacttacaagtaggaaaacacaaaagtatacgacaactaattaaactttcccgaaggggtaccaggtacgtaccaagtaccgaagttacggaaacccaacgaaacgaaccaaaccgtaactaccccgaaacggaacgaccctaaaccgttcggaaccccttaaacgaacgttacggggtaaaaccttacgggaaaccgggtaaaccccgttagggaacggtaaacgttccggttaacggaaaccggtaacccggtaaacccgggttaccctttaaagttaaccgtttaagttacggtacggtacccggtaaaggtaaacggtaaaccgttaaaacgtttccccgttaaacccgtttaaacctaaacgttaaaccgtttaaaccggaaaccggttaaacggttaacggggtaaacgtttacggtttaaccttttttaaaccgg

SEQ ID NO: 436312 - DNA, 568 bp, Homo sapiens
  misc_feature: GZ8MTXP02GF24I.38.25.C03.1.454.CMB.2.raw
  modified_base (428)..(428): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgagtggatgggatggatcagcactacaataggaaaacacaaagtatacgacactataaatttccgaagggcagagtacatcaatacgaacctacacgacacactaccacgagcactgacctanatagaactggaagactgatatacgtacgacgacgtacggtcttaatactttagtgtaggacgtaaggacgtaaactaaacttccctaaccttacaattaacttacggaacgtagtacggtaaatcggttactttttaacg

SEQ ID NO: 436313 - DNA, 558 bp, Homo sapiens
  misc_feature: GZ8MTXP02JMYGS.38.25.C03.1.454.CMB.2.raw
  modified_base (421)..(421): a, c, t, g, unknown or other
  modified_base (432)..(432): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttggagtggatgggatggatcagcacttacaagtaggaaacacaaaagtatacgacacattaaacttccgagggcagagtcaatcatcgaacacaagacaacataccgacgagcctaacncgaccctaaanacgacgaactaggaacgacagagactacgacgacgacgacgtacttattattagtcgtacgacgagactaactaacttcctactaactattaacgtacgaagtagtaggtacttacgttactttag

SEQ ID NO: 436314 - DNA, 534 bp, Homo sapiens
  misc_feature: GZ8MTXP02HSLBK.38.25.C03.1.454.CMB.2.raw
  modified_base (315)..(315): a, c, t, g, unknown or other
  modified_base (375)..(375): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactcccctggctgtgtctctgggcgagagggccaccatcaactgcaagtccagccagagtgttttacacaggtccaaacaataagaattacttcgcttggtaccagcagaaaccaggacagcctctaaagttgctcatttacngggcatctaccgggagtccggggtccctgaccgacttcagcgcagcgggtctgagacagntttcactctcacatcagcagcctagcaggctagagagtgtggctagtttattacgtgtcagcagtattatagtagtctctacgtacgttttcgggaccggggtacgaacgtccgtaggacgagtaacgaaaacgtacgtaggtacggctcggactaccg

SEQ ID NO: 436315 - DNA, 556 bp, Homo sapiens
  misc_feature: GZ8MTXP02HA985.38.25.C03.1.454.CMB.2.raw
  modified_base (401)..(401): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacgaagggcttgagtggagtgggatggatcgagcacttacaataggaaacacgaaagtatcgacactataactttccgaggggtacaggtagtacatacatgaaccanacgacacatccgacgacgcactgacctacacgtagaactgacggaacctgacgtatcgagacgacgacggtaccttagtatttaagtgtagcgtaaagacgtaactaaacttcctactaactataacgtacgaacgataggacgttgacttttac

SEQ ID NO: 436316 - DNA, 697 bp, Homo sapiens
  misc_feature: GZ8MTXP02G18T7.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacttacaatggaaaacacaaagtatcgacacaattaactttccgaaggggcaggacgttacaagtacagtacgaaccaacaacgacaacctactaccaacgacgtacaccgtcgaccctaacgagttacgggaaactgggaaacgggtaacccttagggaacgtacgttaccgtacggaaaccggaccgtaccgggtaccctttaaggttaaacttttagttacggtacggttacccggaaaggtaaacggtaaacccttaaaacgttttcccctaacccctttaaactaactttaaaccggtttaaacccggtaaacggttaaacgttacgggggttaaaacgtttgggtttaacccgtttttttaaacg

SEQ ID NO: 436317 - DNA, 639 bp, Homo sapiens
  misc_feature: GZ8MTXP02G4R7N.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagctgggtgcgacacggcccctggacgaggctgagtggagtgggatggatcgagcacttacaagtaggaaaacacaaagtatcgacactataactttcgagggtcaggagtcatacatacgaaccacaagacacactacccaacgagacactcgaccctaagagtacggaaactggaaacggtaacctgaacgtattaccgaggaaccgaaccgtacggtacctttaagttaatttagttacggtacggtacggaaggtaaacggtaaaacctaaaaccgttttccctaaacccttaacttaaacgttaacgttaaaccggtaacggtacggttagggtaaacgtttcgttaacgttttttaacg

SEQ ID NO: 436318 - DNA, 691 bp, Homo sapiens
  misc_feature: GZ8MTXP02H76YZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacgagggcttggagtggagtgggatggatcgagcacttacaataggaaacacaaagtatagacaacataaactttccgaggggtcaggacgtacagtacatacgaaccacaacgacacactaccgaacgacgtaccaccgttacgaccctaactacgtacggtaaaccgtacgggaaaccgggtaaacccgttaggaaacggtacttaccgttacggaaaccgaaccgtaaccgggtaaccctttttaaagtaacttttaacgtttacggttacggtaccggtaaaaggtaaacgtaaaccttaaaacgttttaccctaacccttttaactaaactttaaacgttaccggtaaaacgtacggttaagggtaaacgtttcggtttaactttttaacg

SEQ ID NO: 436319 - DNA, 571 bp, Homo sapiens
  misc_feature: GZ8MTXP02JR3T5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaagtggaaaacacgaaaagtatcgacacataactttccgaggggcaggagtcatcatcgaccacagacacactaccacgagcactcgacctacagtaggaaactggaaacggtacctagagtatacgtagaaccgaacgacggtaccttaattagttattggtacgacgaagacgaactaaacttcctaccttaacgaattaacgttacgaacgtacgtaggaaagttcgtaccttttaag

SEQ ID NO: 436320 - DNA, 604 bp, Homo sapiens
  misc_feature: GZ8MTXP02GX2GX.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggctgagtggatgggatggatcagcacttacaatggaaaacacaaagtatagacacataactttccaagggcagagtacatacatacgaccacaagacaacactaccaagagcaactgaccctaacataggaaacctggaaacgggaacctaggaagactacgacgaaccgaacgtacggtactttaagttaagtttacgttaggtacgacggtaaagtaaacgtaaaccttaaactttaccctaactttaacgtaacttaacgttaacgaacgtacgttaaggtaacgttcgttacttttaacg

SEQ ID NO: 436321 - DNA, 661 bp, Homo sapiens
  misc_feature: GZ8MTXP02FSC4N.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttacacttttagctagttatggtgtcagtcgtgggtgcgacacgggcccccgtggaccgaagggcttggaggtggagtggggatggatcgagcactacaagtaggaaaacaacaaagtatacgacacaattaaactttccgaaggggtacaggtaagtacaattaccaagtacgaaacccaacaacgaaccaaccaactacccgaacgacgaccacgtacgaccctaacaagtacggaaaacttcgggaaacgggaacccttaggaagtacgtacgtacggaaccgaaccgaaccggttacccttaagttaatttaagttggtaccgagaaggtaacgtaaacttaaaactttcccttaccttaacgtaattaacgttaacggaacgtataggtaaagttcgtactttttaacg

SEQ ID NO: 436322 - DNA, 509 bp, Homo sapiens
  misc_feature: GZ8MTXP02FWBW2.38.25.C03.1.454.CMB.2.raw
  modified_base (449)..(449): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcaagaaaccaggacagcctcctaagttgctcatttactgggcatctacccggggagtcccggggtcctgaccgattcagcggcagcggtctgagacagatttcactctcaccatcagcagcctgcaggctgaagatgtgctagtttatactgtcagcagtattatagtagtctnacgtcgtttggaccggggtacaacgcgtaggagataacgaaacgaactgtgctcgctacc

SEQ ID NO: 436323 - DNA, 568 bp, Homo sapiens
  misc_feature: GZ8MTXP02IKPTA.38.25.C03.1.454.CMB.2.raw
  modified_base (394)..(394): a, c, t, g, unknown or other
  modified_base (521)..(521): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacacggcccctggacaagggcttgagtggagtgggatggatcgaggcacttacgaatggaaaacacgaaagtatcgacacataattcgaggcagatacatcatcgaaccanacgacacataccagacgcactagacctacagtagaactaggacgtaacgtgagatacgtagaacgacgacggtaccttaagtagtttacgtgtacgacgaagacgaaataaacgttcctaccttaanacttaaagttaacgacgtaagtacggaacgttacgttacttttaacg

SEQ ID NO: 436324 - DNA, 530 bp, Homo sapiens
  misc_feature: GZ8MTXP02G563B.38.25.C03.1.454.CMB.2.raw
  modified_base (435)..(435): a, c, t, g, unknown or other
  modified_base (439)..(439): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggatgggatggatcagcacttacaatggaaaacacaaaagtatagacacaataatttccaagggtcagagtcatcatgaccacagacacatccacgagcaactgactacatggaactgaggactganatcngacacacggccttatattattgtgacgagacgacaaaattccctacttactaataacttaacgaacgtagtaggaacttaggacttttaag

SEQ ID NO: 436325 - DNA, 545 bp, Homo sapiens
  misc_feature: GZ8MTXP02HZRBK.38.25.C03.1.454.CMB.2.raw
  modified_base (384)..(384): a, c, t, g, unknown or other
  modified_base (411)..(411): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggctgagtggagtgggatggatcagcacttacaatggaaacacaaagtatgacacataatttcagggcagagtcatcatgaccanagacacactacacgagcactgacctanatgaactgagaacctgagatactagacgacacggtacttataattagttagtcgacgaagacgaactaaaacttcctaaccttaacaacttaacgttaacgaacgtacgtaggtaaaagttcgtaccttttaag

SEQ ID NO: 436326 - DNA, 656 bp, Homo sapiens
  misc_feature: GZ8MTXP02H7JYL.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagctgggtgcgacgacggcccctggacaagggcttgagtggagtgggatggatcgagctacttaacaagtaggaaaacaacgaaagtatcgacactaataactttacgaggggtacagagtacaattcatacgaaccacaacgacacaactcccaaacgagaccactacgtaccctaagacgttacggaaacttaggaaacggtaaaccgttaggaaggtactaccgttacggaaaccggtaaccgtaaccgggtaccttttaaagttaagttttaacgtaggttacgtaaccggaagtaaacgaaaccttaaaactttacccctacctttaactaattaaccgttaacgaacgtacgtaaggtacgttactttacgtttaac

SEQ ID NO: 436327 - DNA, 597 bp, Homo sapiens
  misc_feature: GZ8MTXP02IVEY3.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacaggcccctggacaagggcttgagtggatgggatggatcagcacttacaagtaggaaaacacaaagtatacgacacaattaactttccgaggggtacagagtacatacatacgaccacagacacactccaacgacacactcgacctacatacggaactaggaacgaaccgtagacgtagtacgtagaaccgaacgtaccggtacctttaataagttattagtaggacgaaaggaacgtaactaaaactttcccttaccttaaactaacttaacgttaacggaactagtggtaaaacgtgttaccttttaacg

SEQ ID NO: 436328 - DNA, 579 bp, Homo sapiens
  misc_feature: GZ8MTXP02IRP6F.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcgagctaactttacaaagtaggaaaacacaaaagtatacgacaacaattaaactttccgaaggggtacaggacgtcaatcaatcgaaaccacaacgacaacaactaccgaacgagacaactcgaccctaacagtcggaaactggaaacggaacctgaagtactcgacgacgaacgacggtccttaattattaagttgtagacgagaacgaactaaacttcctacttacattaactagacataggtatcgtactttac

SEQ ID NO: 436329 - DNA, 769 bp, Homo sapiens
  misc_feature: GZ8MTXP02HQUWT.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtcgtgggtgcgacgacggcccctggacgaagggcttgaggtggagtgggagtggatcgaggctaacttaacaagtaggaaaacaacgaaaaggtatacgacaactaatttaaacgtttccggaaggggtacaggtacgttacaatacgaagtacgaacccaaacaacgaaccaaactactaccccgaacggaacgacctaacccgttacgaccccttaacgaaagttacggggaaaaccgtttacgggaaacgggtaaacccttagggaaacggtactttaccgtacggaaaccggtaaccgtaaccgggtttacctttaaacgtttaaagtttaacgtttacgggttaggacccggttaaagggaaaccgtaaaaccttaaaaccgttttaccccttaaccccgtttaaataaacgtttaaaccgtttaaaccggaaaccggtttaacggtaacgggtttaaaacggttcggttttaacgtttttttaaaccg

SEQ ID NO: 436330 - DNA, 539 bp, Homo sapiens
  misc_feature: GZ8MTXP02GXYNU.38.25.C03.1.454.CMB.2.raw
  modified_base (399)..(399): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggagtgggatgggatcagcacttacaatggaaaacacaaaagtatacgcacataatttccagggcagagtcatcatgaccacagacacanccacgagacaactcgacctacagtacgaaactcgaaagggaacctagagaagttcagacgacaacggcttatattatgtgacgagacgaacaaaacttcctaccttacattaactacgaacgtatggaacgtgactttta

SEQ ID NO: 436331 - DNA, 624 bp, Homo sapiens
  misc_feature: GZ8MTXP02GL57S.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcgagcacttacaataggaaacacaaaagtatgacacaataatttccaagggcagagtacatcatgaccacagacacataccagacgacactgacctaacatacggaaactagaacggtaacctagaagaacttcgtagaaccgaaccgacggtacctttaagttaactttaagttacggttaggacggtaaaggaagtaaaacctaaaactttccccttaaccctttaaactaaactttaaacgtttaacccggaaacggttacgttaacggggtaaacgtttacggtttacctttttaaacg

SEQ ID NO: 436332 - DNA, 567 bp, Homo sapiens
  misc_feature: GZ8MTXP02GCH96.38.25.C03.1.454.CMB.2.raw
  modified_base (416)..(416): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaagtggaaaacacaaaagtatgacacataatttccagggcagagtcatacatcgaccacagacacatccacgagcaactgacctanatgaaactggaacggaacctgacgatactacggaacgacgaacggtacctttaatatttaagttggtacgacgtaagacgtaaactaaacttccctaccttaacaacttaacgttaaacgaacgtataggtaacgtaggtaccttttaacg

SEQ ID NO: 436333 - DNA, 535 bp, Homo sapiens
  misc_feature: GZ8MTXP02JL8I0.38.25.C03.1.454.CMB.2.raw
  modified_base (390)..(390): a, c, t, g, unknown or other
  modified_base (398)..(398): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaacacaaaagtatcgacacataactttccgagggcagagtcatcatcgaccanagacacanccagagcactgacctacatcggaactagacgggaacctgagatcagaccgacgacggtccttatattaagtgtgacgaggaactacaaactttcctaccttacataattaccgactagtaggaatcgtacttttaag

SEQ ID NO: 436334 - DNA, 518 bp, Homo sapiens
  misc_feature: GZ8MTXP02HJ9EG.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacaggtccaaacaataagaattactcgcttggaccagcaagaaaccaggacagcctcctaagttgctcatttactgggcatcgtacccgggagtcccggggtccctgaccgatcgagcggcagcggtctgagacagatttcactctcacatcagcagccctgcaggctagaagatgtgctagtttatactgtacagcagtattatagtagtcctatacgtacgtttcgggaccgggacctaaagcgtagagataacgaaaacgaacgtgcggctacgacaac

SEQ ID NO: 436335 - DNA, 600 bp, Homo sapiens
  misc_feature: GZ8MTXP02JA2D3.38.25.C03.1.454.CMB.2.raw
  modified_base (352)..(352): a, c, t, g, unknown or other
  modified_base (398)..(398): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgaagggtcttggaggtggagtgggatggatcgagctacttacaataggaaacanaaagtatcgacaatataattccgagggcagatcatcaatcgaccanaacgacacacgtacccaagacgacacctcgacctacagtacggaaaccgtggaaacggaaccgtagaacgtatacgtacgaaccggtaaccgacggtaccttaagttagtttagtagtacgacgaagaaacgtaaactaaacgttccctaaccttaataattaacgtaacgacgtaagtaggtaacgtcgttacttttaacg

SEQ ID NO: 436336 - DNA, 574 bp, Homo sapiens
  misc_feature: GZ8MTXP02IAWAC.38.25.C03.1.454.CMB.2.raw
  modified_base (527)..(527): a, c, t, g, unknown or other
tcagtcgatcacgtcacgaccggtgctcgatttagtagtgtagatttgggtttggggacccaaaaaccacacccctcccttgggagaatccccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctggttactacttttagctagttatggtgtcagctgggtgcgacacggcccctggacaagggcttgaggtggatgggatggatcagcacttacaatggaaaacacaaagtatgacaacaataactttccagggcagagtcaattcaatcgaaccacacgaacacactaccaacgagacactagccctaagactggaaacctggaacggaacctgaagatctagaacgacacggtcctttaatattagttgtagacgagaacgtaactaaaacttcctacccttanaaacttaacgttaaaccgacgtaatagggtaacttgtaccttttaag

SEQ ID NO: 436337 - DNA, 660 bp, Homo sapiens
  misc_feature: GZ8MTXP02JOTEO.38.25.C03.1.454.CMB.2.raw
  modified_base (355)..(355): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctggacaagggcttgagtggagtgggatgggatcgagctacttaacaagtaggaaaacanaaagtatcgacaactaattaaactttacccgaaggggacaggtacgttacaacttacgaatacgaaacccaaacgaacgaaaccaacactaccgaacgacgaccacgtcgaccctaacgagtacggtaaacctggaaacggaacctaggaacgtacgttacgacgaaccgtaaccgtaacggtacctttaagttaagtttagttacggtaggtacggaacgtaaacgtaaacttaaacgttcccttaaccttaacgtaattaacgttaacgaacgtaagtcggtaaacgttcgttactttttacg

SEQ ID NO: 436338 - DNA, 520 bp, Homo sapiens
  misc_feature: GZ8MTXP02JATNR.38.25.C03.1.454.CMB.2.raw
  modified_base (387)..(387): a, c, t, g, unknown or other
  modified_base (408)..(408): a, c, t, g, unknown or other
  modified_base (429)..(429): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccattcaactgcaagtccagccagagtgttttacacaggtccaacaataagaattactcgcttggtaccagcagaaaccaggacagcctcctaagttgctcatttactgggcatcgtacccgggagtccggggtccctgaccgattcagcggcagcggtctgagacagatttcactctcaccntcagcagcctgcaggctgaanatgtgctagtttatactgtanagcagtattatagtagtcctcacgtacgttttggcggggtaaccaagtccgaggagagtaacgaaaacgacgtagtggactcgactaaccg

SEQ ID NO: 436339 - DNA, 523 bp, Homo sapiens
  misc_feature: GZ8MTXP02JTY1M.38.25.C03.1.454.CMB.2.raw
  modified_base (344)..(344): a, c, t, g, unknown or other
  modified_base (473)..(473): a, c, t, g, unknown or other
  modified_base (477)..(477): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttggagtggatggggatggatcagcacttacaatggaaaacanaaagtatgacacataatttccagggcagagtcatcatgaccacagacacatccacgagccactcgacctaacatcgggaaactggacggaacctgaacgatctagacgacacggtccttatattatgtncgangaacaaacttccacttacataatacgtacgattggaactgacttta

SEQ ID NO: 436340 - DNA, 583 bp, Homo sapiens
  misc_feature: GZ8MTXP02GJMCN.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagcgtgggtgcgacacggcccctggacgaagggcttggagtggagtgggatggatcagcacttacaataggaaaacacaaagtatacgacactataatttaccgagggacaggtagtacatacagtacgaccaacagacaacactaccacgacgacactcgacctaacagtacggaaacgtgaacggaacctggaagatactagacgacgacggtacttaactagttagttgtagtacgagtacgaaactaaactttccctacttaactaataacgttaacgacgtacgtaggtaagttcgtacttttaacg

SEQ ID NO: 436341 - DNA, 716 bp, Homo sapiens
  misc_feature: GZ8MTXP02I9AH6.38.25.C03.1.454.CMB.2.raw
  modified_base (428)..(428): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacgacggcccccgtggaacgaagggtcttaggaggtggagtgggatggatcgagcacttacaagtaggaaacacaaaagtatacgtacaactaattaacgttaccgaaggggcaggtagtacaacttacaagtacgaacccaanaacgaccaacaacaccaacggaacgactaccgtacgaacccttaacgaagtacggtaaacgtacggaaacgggtaaaccctaggaaacgtacgttaccgtaacggaaccgaacggtaacccggttaacctttaaagttaaacgttttagttaggttacggaacggtaaggtaaacggtaaaaccttaaaaccgtttcccctttaaaaccgtttaaccgttaaattaaaccgtttaacggtaaaccgttaaacgtaagggtaaacgtttacggttacgttttttaaacg

SEQ ID NO: 436342 - DNA, 570 bp, Homo sapiens
  misc_feature: GZ8MTXP02IDPG4.38.25.C03.1.454.CMB.2.raw
  modified_base (349)..(349): a, c, t, g, unknown or other
  modified_base (384)..(384): a, c, t, g, unknown or other
  modified_base (436)..(436): a, c, t, g, unknown or other
  modified_base (443)..(443): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtctagctgggtgcgacaggcccctggacaagggcttggagtggagtggatggatcagcattacaatggaaacacaaagtngacacataattcagggcagagtcatcatcgaccanagacacatccaagagacactgaccctaacatggaaactgaaggaacctgganattacgngaaaccgtacaacggtcctttaatatttaagttgaggacgaagtaagtaaacaaaactttccctaccctttaacaattaaaccgtttaaccgaacgtaacgttaggaaacgtttgtaacctttttaa

SEQ ID NO: 436343 - DNA, 546 bp, Homo sapiens
  misc_feature: GZ8MTXP02HB8TF.38.25.C03.1.454.CMB.2.raw
  modified_base (413)..(413): a, c, t, g, unknown or other
  modified_base (419)..(419): a, c, t, g, unknown or other
  modified_base (427)..(427): a, c, t, g, unknown or other
  modified_base (438)..(438): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaaggacttgagtggatgggatggatcagcacttacaaatggaaaacacaaaagtatgacacaataaatttccaaggggcagagtacatcatgaccaacagaacacatccacgagcacncactanatagaacngaacgacaganatacagacgaacgacgtacttaatattatgtacgacgagaacaaactaaacttacctaccttaactaataagttaacgtaacgtacgtaggtaacgtacgtactttac

SEQ ID NO: 436344 - DNA, 752 bp, Homo sapiens
  misc_feature: GZ8MTXP02JM0TW.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggccccctaggacaagggcttgagtggagtgggatggatcagcacttacaagtacggaaaacacgtaaagtatacgactactaattaaacgtttcccgaaggggtccagggtacgttacaaacgttaccaacgttacggaaaccccaaacgtaaacgtaaaccaaaccgaacttaccccgaaacggaacggacctaaaccggtcggtaacccccttaagaaacgtacgggttaaaacccgtaggaaacgggaaacccttaggaaccgtagttaccgtacggaaccggaaccgtaaccggggtaccctttaagttaaccgtttaagttccggttacggtaccggaaaggttaaacggaaaccgttaaaacctttcccccgttaaacctttaaccgtaaattaaaccgtttaacggaaacccgtaacggttacgggtaaacgtttcggtttaaccgttttttaaacg

SEQ ID NO: 436345 - DNA, 530 bp, Homo sapiens
  misc_feature: GZ8MTXP02FQ0HW.38.25.C03.1.454.CMB.2.raw
  modified_base (368)..(368): a, c, t, g, unknown or other
  modified_base (384)..(384): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaacacaaagtatgacacataatttcagggcngagtcatcatgaccanagacacatccacgagcaactgacctacagtggaaactgaacgaactgagactctagacgacacggtaccttatattattgtcgacgagacgaactaaacttcctacttacataagttacgacgagtaggaagtcgtacttttaacg

SEQ ID NO: 436346 - DNA, 595 bp, Homo sapiens
  misc_feature: GZ8MTXP02F5VN0.38.25.C03.1.454.CMB.2.raw
  modified_base (313)..(313): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcaagaaaccaggacagcctcctaagttgctcatttacngggcatcgtacccgggagtccggggtcctgaccgacttcgagcggcaggcgggtctggacgacgagtactttcgacttcctacaaccatccgagcagccctgcgaaggctagaaagtagtggtcggattacggtttattaccttgtaccagtactagttaattagtagtacgttcctacgacggttacgtttacggggacccgggggtaacctaaaggtccgttagggacgtaacgttaaccgaaaacgtaacgtggtaggaccgttacggacctaaacccg

SEQ ID NO: 436347 - DNA, 711 bp, Homo sapiens
  misc_feature: GZ8MTXP02HDASG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgaagggcttggagtggagtgggatggatcagctacttacaagtaggaaaacacgaaaagtatacgacaactaattaagtttacccgaaggggtacaggacgttacaagttacatacggaaacccaacaacggaacaaacctaactacccgaacggaacgtacctaaccgtcgaacccttaaacacgtaacgggtaaacctacgggaaaaccggaaaccggttagaacgtaaacgttaccgtacggaacccggaaaccgtaaccgggtaccctttaaattaacgtttaagttgggttaacggacggaaacggtaaaggtaaacctaaaacgtttccccttaacctttaacgaaactttaacgttaaaccggtaacgtaacggttacggtaagtttacggttaacctttttaacg

SEQ ID NO: 436348 - DNA, 642 bp, Homo sapiens
  misc_feature: GZ8MTXP02JTA6T.38.25.C03.1.454.CMB.2.raw
  modified_base (358)..(358): a, c, t, g, unknown or other
  modified_base (421)..(421): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacagggcttgagtggagtgggatggatcgagcacttacaatggaaacacaaagtatcgacanataacttccgaagggcagagtcatcatacgaccacagacacacaccagacgcactgaccctanagtacgaactcggaacgaacccgtgaacggtactacgtacggaaccgtaacgtaccgggtaacctttaatacgtttaacgttaggttacgtacggaaacgtaacggtaaaaccgttaaacgttttacccctaacctttaaaccgtaaactttaaacgtttaaaccccggaaacggttaacgttaacggggtaaaagtttcgggtttaacccttttttaacg

SEQ ID NO: 436349 - DNA, 760 bp, Homo sapiens
  misc_feature: GZ8MTXP02HKGHB.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaataagaattactcgcttggtaccagacaagaaaccaggacagcctacctaagttcgactctaatttacgtgggactacgttaccggtacccggggacggttccccgggggtacccctacggtaccgtacgttccgaacggccgggacgacggggtccggggttctcgggaacgaacgtaagtacttttccaacctccttacccaaccctactaccgaacgaccgaacgtcccgtacgaccgaacgggtaccgtaagggaaacgtagttagggttacgggttacgtttaaacggtttttaacgtttaaccgttaggttaacgtacggtaccttaaggtttaaactttaacgttaaggtttaacgttacccgttaacgttaacggtttaaccgggtttttaccgggggaacccgggggtaaaccgtaaacgggtaccggtaacgggtaagtaaacgtaaaccggtaaaacggtaacggttacggtacggtaccgttacggaccttaacccg

SEQ ID NO: 436350 - DNA, 633 bp, Homo sapiens
  misc_feature: GZ8MTXP02JYCUD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagcgtgggtgccgacacggcccctggacaagggcttaggagtggagtggggatggatcagcacttacaagtaggaaaacaacgaaagtatacgacacattaacgtttccgaaggggtcaggacgtacaatcaatgaaccacaacgacaacatacccacgacgacactcgaccctaacagtacggaaacgtggaaacggaaccgtggaacgtagtacgtacggaaccggaccgtaacgggtaccctttaattaagtttaacgttcggttaggaccggttaagaacggtaaacctaaaacgtttcccctaccttaaccctataacgttaccggaacgtacgtaggaacgtttcgtactttttacg

SEQ ID NO: 436351 - DNA, 669 bp, Homo sapiens
  misc_feature: GZ8MTXP02JIQKX.38.25.C03.1.454.CMB.2.raw
  modified_base (448)..(448): a, c, t, g, unknown or other
  modified_base (603)..(603): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtggtgcgacacggcccctggacgaagggtcttgaggtggagtgggatggatcgagctacttacgaataggaaaacacaaaagtatacgacactaagttaactttccgaggggcagtagtacatcaagttcgaaccacgaagacaacactaccaagacgacactcgaccctanacgtaggaaactggaaacggtaaccctaggacgtattaccgtacggaaccgaaccgtaacccggtacctttaaatttaacgtttaaacgttcggttaggaaccgttaagggaaacgtaaaaccttaaaacgttttaccccttaaccccgtttaanaaacctttaaagtttaacccggaaacggtacgtagggtaaaacgtttcggttaacttttttaaacg

SEQ ID NO: 436352 - DNA, 745 bp, Homo sapiens
  misc_feature: GZ8MTXP02JEC7V.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagtcgtgggtgcgacaggcccctggacagggcttgaggtggatgggatggatcagctacttacaataggaaaacacaaaaggtatacgacaacgaattaaacgtttcccgaaaggggtacctagggtaacggtacctaaacgttccgaaagttaccggaaaccctaaacgaaacggtaaacccaaaccggtaacttaccccgaaacggtaaccgaccctaaccgttacggaccccttaaacctaaacgtacgggtaaaaccgttacgggaaacgggtaaaacccctagggaacgtaaacgttacgtaaacgacccggtaaacgtaaccgggtaaccctttaattaacgtttaacgttagttacggtacgaaacggaacggtaaacgttaaaactttcccttaaacccttacttaaacgttaacgttaaccggaaaccgtagttaacggtaacgtttacgttacctttttaaacg

SEQ ID NO: 436353 - DNA, 772 bp, Homo sapiens
  misc_feature: GZ8MTXP02IVRIP.38.25.C03.1.454.CMB.2.raw
  modified_base (360)..(360): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacgaagggcttggaggtggagtgggatggatcgagcacttacaagtaggaaaacacgaaaagtntacgacaactaattaaactttccgaagggtacaggtacgttacaacgtacaagtacggaaacccaacgaaacgaaaccaactaacctacccgaaacgaacgacctaaccgttacgacccttaaacgaagtacgggtaaaaccttacggggaaaacggtaaaacccgttgaaacggtacgttaccgtaacggaaacccggaacgtaacccggggttaacctttaaatttaacgtttaacggtttacggttacggaacccgggtaaaaggtaaaacggtaaaacccgttaaaaaccgttttccccttaaaacccgtttaaacgtaaaactttaaacgtttaaaaccccggtaaacgggttaaacgttaacggggtttaaaacggtttaccggtttaaacctttttttaaaccgg

SEQ ID NO: 436354 - DNA, 550 bp, Homo sapiens
  misc_feature: GZ8MTXP02GHFRJ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaaacaacaaaagtatgacacataaatttccagggcagagtcatcatgaccacagacacatccaacgagcaactgacctaacataggaaacctgaaggacctgagatctagacgacacggaccttaatattaagttgtagacgaagacgaactaaaattccctaacttaccaattaagttaacgaacgtagtaggaaacgtgtactttttaacg

SEQ ID NO: 436355 - DNA, 564 bp, Homo sapiens
  misc_feature: GZ8MTXP02J157L.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagctgggtgcgacaggcccctggacaagggcttgagtggatgggatggatcagcaacttacaatggaaacacaaaagtatcgacacataaatttccaggggtcagagtacatcatagaccacagacacactaccaacgagacactcgacctaacgatacggaaactgaaacgggaacctgaagacgtacgtagaccgtaacgaccgggtaccttagttatagttgtagacgagacgaacctaaacttcctacttaacaataagttaacgacgtagtagtacgtagtactttta

SEQ ID NO: 436356 - DNA, 664 bp, Homo sapiens
  misc_feature: GZ8MTXP02IA0FT.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacgacggccccctagggaccaaggggtcttggaggtggagtggggatggatcagctacttacaataggaaaacacaaaagtatgacctactaataactttccgaaggggtcagaagttcattaccagtacgaccaacacgacacacaccgaacgacgacaactcgacctaacacgtcggaaactggaaacgggaacctggaagaattcgaacgaaccgacgtacggtacctttaaatacttttaaagttcggtaggtaccgtaaagacggtaaaaccctaaaacttttcccctaaccggttttaaaccaatttaaaaccgtttaaccggaaacggttaacgttaacggggaaaacggttttacgtttacctttttaacg

SEQ ID NO: 436357 - DNA, 575 bp, Homo sapiens
  misc_feature: GZ8MTXP02GKS45.38.25.C03.1.454.CMB.2.raw
  modified_base (313)..(313): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcaagaaaccaggacagcctacctaagttgctcatttacngggcatccgtacccgggagtcccggggtccctgaccgacttcgagcggcaggcgggtctgagacagtattcactctcaccatcagcagccctgccaggctagaaagatggtaggacttagtttatactgtacagctaagttattaagtagtacgtcctacgtaacgttacgtttcggggacccgggggtaacctaaaggccgtagggaacgtaacgtaaccgtaaaacgtaacgttcggtacggtcctacggaccctaaccg

SEQ ID NO: 436358 - DNA, 666 bp, Homo sapiens
  misc_feature: GZ8MTXP02HUL0D.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacgaagggcttgagtggagtgggatggatcgagcacttacaataggaaacaacgaaagtatcgacaactaattaacgtttccgaggggtacaggtagtacaatccgaatcgaaccacgacgaacaacactaccaacggacgacacctcgaccctaacgagtacgggaaacctgggaacggtaaacctggaagtaactccgtagaaccggtaaccgaccgggtacctttaagttaagtttaagttacggttaggtacggtaaggtaaacggtaaaccttaaaacgttttaccccgtacccttttaaacaactttaaacgttaacccggaaacgtacgttaagggtaaacgtttcggtttacctttttaacg

SEQ ID NO: 436359 - DNA, 636 bp, Homo sapiens
  misc_feature: GZ8MTXP02JEYQD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacaagggcttgaggtggagtgggatggatcagcacttacaagtaggaaacacaaagtatagacaacaataacgtttccgaagggtcagagtacattacaatacgaacccacgaacgaaccaacactaccgaacgagccactacgaccctaacgagttacggaaacctggaaacgggaaccctaggaacgtaacgtaccgtaggaacccgaacgtaccggtacctttaagttacgtttaagttggtacgaccggaaagtaaacgaaacctaaacgtttccctaacctttaacaatttaacgtaacgtaaacgagtagggaagtttacgtactttttaacg

SEQ ID NO: 436360 - DNA, 691 bp, Homo sapiens
  misc_feature: GZ8MTXP02JE57F.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacgaagggcgttgagtggagtggggagtggatcgagcattaccccccaagtaggaaaacaacaaaagtaatacgacacgtaataaactttaccgaacggggacaggagtacatacaatacgaaccaacaacgaacaacactaccacgacgacacctacgaccctaacacgttacggaaacgttacggaacgggaaacccgttacggaacggactacgtacggaccggaaccgaaccgggtaccctttaattaactttaagttacggttacggtacggtaaggtaaacggtaaaccttaaaacgtttacccttaaccctttaactaaactttaaacgttaaaccgtaacggtaacgttaacggggttaaaaggtttacgttaacgttttttaaaccgg

SEQ ID NO: 436361 - DNA, 667 bp, Homo sapiens
  misc_feature: GZ8MTXP02JTUQB.38.25.C03.1.454.CMB.2.raw
  modified_base (346)..(346): a, c, t, g, unknown or other
  modified_base (366)..(366): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttagtggtgtcagcgtgggtgcgacgacggccccgtggacgaagggtcttggaggtggagtgggatggatcgagactactanaagtaggaaacacaaagtancgacactaattaacttccgaggtcaggagtacatcatacgaccacgagaaccacacgtccaacggacacacctacggtaccctaacgaggtaacgtaaacgagggaaaccggtaaccgtagacgtacttacgacgaaacgaccgtaccggttacttaaagttagtttaacgtggttacggacggaacggtaaaagtaaacccttaaacgtttccccttaaacctttaacgtaacgttaaaaccgttaaccggaaacgtacggttaaggttaaaacggtttcgtttaacgttttttaaaccg

SEQ ID NO: 436362 - DNA, 524 bp, Homo sapiens
  misc_feature: GZ8MTXP02GA7X4.38.25.C03.1.454.CMB.2.raw
  modified_base (315)..(315): a, c, t, g, unknown or other
  modified_base (400)..(400): a, c, t, g, unknown or other
  modified_base (511)..(511): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggtaccagcagaaacccaggacagcctacctaaagttgactcatttacngggcatcctacccgggagtccggggtcctgaccgattcgagcggcagcgggtctggagacagactttcactctcaccatcagcancctgcagctgaagatgtgctagtttatactgtcagcagtattatagtagtcctactagtacgtttggaccggggaacaacggcgtaggagaataacgaaaacgacgtacgngactcgactaacc

SEQ ID NO: 436363 - DNA, 804 bp, Homo sapiens
  misc_feature: GZ8MTXP02I0NAG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaggcttctggttacacttttagcagttatggtgtcagctgggtgcgacacggcccctggaccgagggtctggagtggagtgggatggatcgagcaacttacgaatacggaaaacacaaaagtatacgacaactaattaaactttcccgaaggggtaccagggtacgtacaacttaccgaacgtacggaaacccaacaaacggaaacctaaacccgaacttaaccccgaaaccggtacgacctaaccgtacggtaaccccttaaaccgaagttaccggggaaaaccttacggggaaacgggaaaaccccgttagggaacggtaaacgtttacccgtaaccgggaaaccggtaacccgtaaccgggggttaaacccttttaatttaaacgttttaaacggtttggtaacgggttacccggaaaaggtaaacggtaaaaccctttaaaaaccttttccccgttaaacccgttttaaccgtaaaatttaaccgtttaaaacccgggtaaacggttaaaacggggtttaacggttaaaacggggtttaccttttaaacggttttttttaaacccg

SEQ ID NO: 436364 - DNA, 601 bp, Homo sapiens
  misc_feature: GZ8MTXP02HA6X4.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggctgagtggatgggatggatcagcacttacaagtggaaaacacaaaagtatacgacactaataaacgtttccgaaggggacaggacgttacattcatcgaaccacaagacacactccaacgagacactcgacctaacagtacgaaactggaacggaaccgtagaacgactacgtacgaaccgacgtacgggtacctttaattaagtttaagttggtacggacgtaagaacggtaaactaaactttaccttaccttaactaataacgttaaccgacgtactaggaacgttgtacttttag

SEQ ID NO: 436365 - DNA, 615 bp, Homo sapiens
  misc_feature: GZ8MTXP02I0PKH.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacaagggcttgagtggagtgggatggatcgagctacttacaataggaaaacacaaaagtatcgacaactaattaactttaccgaaggggacaggtacgttacaattacaatacgaaacccaacgaacgaaccaacacgtacccaacgacgaccactcgaccctaacagtacggaaactggaaacggaaccgtgaagtactacgtacgaaccgacgtaccggtacctttaatagttagttgtacgacgaagacgaaactaaacttccctacttaacagttaacgttacgacgtacgtaggtaacgtcgttacttttacg

SEQ ID NO: 436366 - DNA, 562 bp, Homo sapiens
  misc_feature: GZ8MTXP02I9LCG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacaagggctgagtggagtgggatggatcgagcacttacaatggaaaacacaaagtatgcacataactttcagggcagatcatcatgaccacagacacactaccacgagcactcgacctacagtacggaaactggaagggaaccctggaagactacgtgaaccgtacgaacggtacctttaatatttaagttgtacggacgaaagacgaaactaaactttcctaccttaacgattaagtacgaacgtacgtaggtaaagtgtactttta

SEQ ID NO: 436367 - DNA, 592 bp, Homo sapiens
  misc_feature: GZ8MTXP02IZMLG.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctggtgcgacaggcccctggacagggcttgagtgagtgggatggatcagcacttacaagtaggaaaacacaaaagtatacgacaactaataactttccaaggggtcaggagtcaatcatacgaccacaagacacaactccaacgagcactcgaccctaacagtacggaaactgaaacggaaaccctgaacgagttacacggacgaacgtaccgggacctttaatatttaagttgtacgacgaagaggtaaacctaaacttaccctaccttaacctaattaacgttaacgaacgtatacggtaagtcgtactttttaacg

SEQ ID NO: 436368 - DNA, 616 bp, Homo sapiens
  misc_feature: GZ8MTXP02JM3VQ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttacacttttagctagttatggtgtcagcgtgggtgcgacacggcccctggacgaaggggctggaggtggagtgggatggatcagcacttacaagtaggaaacacaaagtatgacaacattaacgtttccgaggcagtagtacatccatcgaaccacacgacactacaccacgagacactcgaccctacagttacggaaacctaggaacggtaaccgtgaacgtacgtacgtaggaacccgacgtaccggtacctttattaagtttagtcggtacgacggaagtaacgtaaactaaacctttcccttaacctttactaaacttaacgtaaccgtaaacgtacgtacggttaaacgtcgttactttttacg

SEQ ID NO: 436369 - DNA, 527 bp, Homo sapiens
  misc_feature: GZ8MTXP02IW28D.38.25.C03.1.454.CMB.2.raw
  modified_base (314)..(314): a, c, t, g, unknown or other
  modified_base (411)..(411): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaacaataagaattactcgcttggtaccagcaagaaaccaggacagcctacctaagttgctcatttacngggacatccgtaccgggagtcccggggtcctgaccgattcagcggcaggcggtctggagacagtattcactctcacatcagcagctgcagctagaantgtgactagtttactactgtacagtactagtattatagtacgtcatacgtacgtttgggaccggggtacacggtcgtaggatagtaacgaaaacgtacgtgagctacgacctaacg

SEQ ID NO: 436370 - DNA, 538 bp, Homo sapiens
  misc_feature: GZ8MTXP02HEVPV.38.25.C03.1.454.CMB.2.raw
  modified_base (350)..(350): a, c, t, g, unknown or other
  modified_base (391)..(391): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcaagaaaccaggacagcctcctaaagttgctcaatttactgggcatcgtacccgggagtccggggtcctgaccgnttcagcggcaggcggtctgagacagtatttcactctcaccntcagcagcctcgcaggctgaagatgtggtctagtttatactgtacagcagttatatagtagtctacgtacgtacgttttgggaccggggtacgacgtcgtaggaagaacgtaacgaaacggtaacgtggtacggactcgactaaccg

SEQ ID NO: 436371 - DNA, 522 bp, Homo sapiens
  misc_feature: GZ8MTXP02F4T2A.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatagacacataactttcagggtcagagtcagtcatgaccacagacacataccacgagcactgcctacatgaaactgaagaacctgagatctagacgacgacggtcttatacttattagtgcgagacgaactaacttcctactacataacgtacgacgatacgagtgtactttacg

SEQ ID NO: 436372 - DNA, 540 bp, Homo sapiens
  misc_feature: GZ8MTXP02I8PVH.38.25.C03.1.454.CMB.2.raw
  modified_base (354)..(354): a, c, t, g, unknown or other
  modified_base (409)..(409): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgtccactcccaggttcaattggtgcagtctggagctgcggtgaagaggcctggggcctcagtgaacgtctcctgcaaggcttctggttacacttttagcagttatggtgtcagctggggtgcgacaggcccctggacaagggcttgagtggatgggatggatcagcacttacaatggaaacacaaagtatgacanataattcaggcagagtcatcatgacacagacacagtaccacgagcactgacctanactaggactagaggaacctgagatacagacgacacggtaccttagtattagttgtcgagtaagacgaactaaacttccctacttaacctataacgttacgaacgtacgtaggtaaacgtgtacctttttaa

SEQ ID NO: 436373 - DNA, 672 bp, Homo sapiens
  misc_feature: GZ8MTXP02IOVHL.38.25.C03.1.454.CMB.2.raw
  modified_base (324)..(324): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacgaagggcttgagtggagtgggatggatnagcacttacaagtaggaaacacaaaagtatacgaccactaattaactttaccgaaggggtaccagggtaacgttacaagttaccaacgttacggaaacccaaacgaacgaaccaacctaactacccgaacggaacgacctaacccgtacggacccttaaacgaacgttacgggaaaccttagggaaacggtaaaacccgttggaacgtagttaccgtaacggaaccgaaccgtaaccggtacctttaagttaacgttagttaggtacggacgtaaggacgtaaactaaacttccctaccttactaattaacgttaacgacgtagtaggtaagttacgtacttttaacg

SEQ ID NO: 436374 - DNA, 563 bp, Homo sapiens
  misc_feature: GZ8MTXP02FWBH1.38.25.C03.1.454.CMB.2.raw
  modified_base (422)..(422): a, c, t, g, unknown or other
  modified_base (456)..(456): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacacggcccctggacaagggcttgagtggagtgggatggatcagcacttacaagtaggaaacaacaaagtatacgacactaataatttccgaagggacaggagtacagtacatacgaccaacagacacatccaacganacactagacctacagtcgaaactgagaacctganatcagacgacacgtacttatattagtgtagacgtagacgtaaactaaacttcctaacttaacaacttaacgttacgaacgtacgtaggtaacgtgttacttttaacg

SEQ ID NO: 436375 - DNA, 566 bp, Homo sapiens
  misc_feature: GZ8MTXP02JQKGA.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggcttgaggtggagtgggatggatcgagcacttacaataggaaaacacaaaagtatacgacaacgaattaaactttccgaaggggtcaggacgtacaatcatacgaaccacagaacacactacccgacgacgcactcgacctacagtgaacctggaacgaactgagatactagacgacgacggtaccttatacttattgtagcgaagacgaactaaacttccctaccttaacataagtacgacgtagtagtagtacgtacttttac

SEQ ID NO: 436376 - DNA, 539 bp, Homo sapiens
  misc_feature: GZ8MTXP02JZ5QW.38.25.C03.1.454.CMB.2.raw
  modified_base (392)..(392): a, c, t, g, unknown or other
  modified_base (478)..(478): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagcgtgggtgcgacaggcccctggacaagggcttgagtggagtgggatggatcgagcacttacaatggaaacacaaagtatgcacataattcagggcagagtcatcatcgaaccacagacanactccacgagcactgaccctacagtcggaaactggaacgaacctgaagactactgaaccgacaccggtcttatatttagtgtacgngagacgaactaaacttcctaccttaacataattacgacgagtaggacgttagtactttaac

SEQ ID NO: 436377 - DNA, 597 bp, Homo sapiens
  misc_feature: GZ8MTXP02H5AGO.38.25.C03.1.454.CMB.2.raw
  modified_base (291)..(291): a, c, t, g, unknown or other
  modified_base (342)..(342): a, c, t, g, unknown or other
  modified_base (348)..(348): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttctggtggcagcagcaacaggtgccccactcccaggttcaattggtgcagtctggagctgcggtgaagaggcctggggcctcagtgaacgtctcctgcaaggcttctggttacacttttagcagttatggtgtcagctgggtgcgacaggccccnggaccaagggcttgagtggatgggatggatcagcattacaatggaaacaanaaatancgacactaataattacgaggtacagtacgtacactactatacgacaacgaacgacaacaactacacgaacgacacctacgtacctaactacgtacgtaacgtacggtaacgtaacgtacgtaacgacgtacgtacgacgaacgacgtacgttaattaagttaagttagttacgacgagtaacgtaactaaacttacctaccttaactactaacgtaacgtaacgtacgtagtacgtacgtacgtttacg

SEQ ID NO: 436378 - DNA, 564 bp, Homo sapiens
  misc_feature: GZ8MTXP02HRU3Z.38.25.C03.1.454.CMB.2.raw
  modified_base (396)..(396): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacttacaataggaaacacaaagtatcgacacataatttccagggcagagtcatcatcgacacagacacanaccacgagcactgacctacagtacggaactgacgaactgagtactacgtagaccgactacggtacctttaagtatttaagttgtcgacggtaagaacgaacctaaaacttccctaccttaacaacttaagttaaccgaacgtagtaggtaagttacgtactttttaag

SEQ ID NO: 436379 - DNA, 591 bp, Homo sapiens
  misc_feature: GZ8MTXP02GJFGX.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgaggccccctggacagggtcttgagtggagtgggatggatcgagcacttacaatggaaacacaaagtatagacacataattccgaggcagagtcatcatgaccacagacacactcacgacgcactgcctaacagtacggaaacgtgaacggaccctagacgacttccgagaccgaacggtaccggtaccctttaattaacgtttaagttcgtacggtacgaaggaacgtaaactaaactttccctaccttaactaacttaacgttacgtaaccgtaagttagggaacgtttacggtactttttaacg

SEQ ID NO: 436380 - DNA, 554 bp, Homo sapiens
  misc_feature: GZ8MTXP02IHTVM.38.25.C03.1.454.CMB.2.raw
  modified_base (321)..(321): a, c, t, g, unknown or other
  modified_base (377)..(377): a, c, t, g, unknown or other
  modified_base (516)..(516): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgacaagtccagccagtagttgttttacacaggtaccaaacaataagaattactcgcttaggaccagcaagaaaccaggacacgcctcctaagttcgctctatttacgngggcagtccgaccgggtagtcccggtcctgaccgtctcgacgcgcagcggtctganacagtacttcactctacactagcagcacgctgcaggctagagtagtagtggtactagtttattacgtagtacagtactattatagtagtagtcctacgtacgttacgtttacgggaccggtaacgacgtacgtaggtanaacgtaacgaaacgtacgtggacgtacgtacgacaacg

SEQ ID NO: 436381 - DNA, 789 bp, Homo sapiens
  misc_feature: GZ8MTXP02HV859.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcaggctggggtgcggacgacggtcccccgtggaccgaaggggtcttaggaggtggagtgggatggatcagcacttacaagtaggaaaacaacgaaaagtatacgacaactaattaaactttccgaaggggtacaggtacgttacaattccgaagtacggaaacccaacgaagaaccaaaccaactacccgaaacggaacgtacaaccgttacgacccctaacgaacgttacgggaaaccgttacgggaaacggtaaaccccgttagggaaacgtaacgtacccgtacggaaacccggaaccgtaaaccggggttacccttttaaattaacgttttaagtttcgggtttacgggaacccggtttaaaggggaaaccgttaaaacctttaaaaaccgttttacccccttttaaacccctttaaacgttaaaacttttaaaaccgttttaaaaccggaaacccggtttaaaggttaacggggtttaaaacggtttaccggttttaaacgttttttttaaccg

SEQ ID NO: 436382 - DNA, 774 bp, Homo sapiens
  misc_feature: GZ8MTXP02HOEB5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacgaagggcttggagtggagtgggatggatcagcacttacaagtaggaaaacacgaaagtatacgacaactattaaactttacccgaaggggtaccagggaacgttacaaacgttaccaagttacggaaacccaaacaacgaaaccaaaccaactacccgaaacggaacgaccaaccttacgaccctaacgacgtacggaaacttacgggaaacgggtaaacccgttaggaacggtaactaccgttacggaaacccggaaaccgtaacccggggtaccccttttaaacggtttaaacttttaacgtttaacggttacgggaaccgggtaaaggtaaaacggtaaaaccgttaaaaaccgttttacccctttaaaccccgttttaaaccgtaaaactttaaaccgtttaaaaccggtaaaccggttaaacggttaaacggggtaaaacgtttccggtttaaactttttttaaaccgg

SEQ ID NO: 436383 - DNA, 541 bp, Homo sapiens
  misc_feature: GZ8MTXP02GNTIV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcagcacttacaatggaaacacaaagtatgacacataattccagggcagagtacatcatcgaccacagacacatccacgagcactgacctacagtaggaaactgaacggaacctgagatcgagacgacacggaccttatattagtcgtgacgagaacgactaaacttcctaccttaacattaacgttaacgacgtagtaggtaagttacgtacttttaacg

SEQ ID NO: 436384 - DNA, 696 bp, Homo sapiens
  misc_feature: GZ8MTXP02JYLRK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgaagggtcttaggaggtggagtgggatggatcgagctacttaacaagtaggaaaacagaaaagtatacgacaacgtaattaactttccggaggggacagacgtacagtacagtcgaaaccacaacgaaccaacactacccgaacgacgaccacctacgaccccttaagacgttacggaaaccgtagggaaacggtaacccgtagaagtacgttaccgtacggaaacccggaacccgtaacccgggtaccttttaaagttaacgttttagttacggttacggtaacggaaacggtaaacgtaaaccttaaaaccttttaccccttaaccgttaactaaactttaaccggttaaacgtaccggtaacgttacgggtaaagtttcggttaactttttacgg

SEQ ID NO: 436385 - DNA, 647 bp, Homo sapiens
  misc_feature: GZ8MTXP02JXL2Y.38.25.C03.1.454.CMB.2.raw
  modified_base (493)..(493): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtcgtgggtgcgacgacggccccgtggacgaaggggtcttggagtggagtgggatggatcgagacactttaacgaagtaggaaaacacgaaaagtatacgacaactaattaactttccgaagggacaggacgtacatccagtacgaaaccacgaagtaccaacactccgaacgagaccactcgaccctacagtacggtaaacgtcgaaacgggtaaccnggaacgacgtacgtacggaaccgtacgaaccggttcttaagttagtttaacgttcggtacggacgtaaacgtaacgtaaacttaaaccttccgtaaccttaactaaagttaacgttaacggacgtagtaggtacgtttacgttactttttaacg

SEQ ID NO: 436386 - DNA, 702 bp, Homo sapiens
  misc_feature: GZ8MTXP02JSLHD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagcagttatggtgtcagctgggtgcgacacggcccctggacaagggcttggagtggagtgggatggatcgaggcaacttacaaagtaggaaaacacaaaaggtatacgacactaataaacgtttccgaaggggtacaggtaagtactaaatacctaagtacggaaacccaacaaacggaaccaaaccaactacccgaaaccggaacgaccgaacctcggacccccttaagaacgttacgggaaacccttagggaaacggtaacccttaggaacgtacgtacgtacgaaccggtaaccgtaaccgggtaccctttaagtaattttaagtcgttagaccggtaaagaacgtaaaactaaactttaccctaccctttaactaacgttaaacgttaacccggtaaacgttaacggtaacgggtaacgtttaggtacccttttttaacgg

SEQ ID NO: 436387 - DNA, 546 bp, Homo sapiens
  misc_feature: GZ8MTXP02FVY6X.38.25.C03.1.454.CMB.2.raw
  modified_base (445)..(445): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaagtaggaaacacaaaagtatacgacacaattaaactttccaagggtcagagtcatccatagaccacagacaacataccacgagcactgacctacatggaactgagaacctganatcacgacgacgacgtacttagtattagttgtacgacgagacgaactaaacttcctaccttaacataattacgacgtaacgtgtaaacgtgtacttttaac

SEQ ID NO: 436388 - DNA, 548 bp, Homo sapiens
  misc_feature: GZ8MTXP02JITYI.38.25.C03.1.454.CMB.2.raw
  modified_base (490)..(490): a, c, t, g, unknown or other
  modified_base (494)..(494): a, c, t, g, unknown or other
tcagtcgatcacgtcacgaccggtgctcgatttagtagtgtagatttgggtttggggacccaaaaaccacacccctccttggggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgaggtggatggggatggatcagctaacttacaatggaaaacacaaagtatacgcacattaatttccgagggtcagagtcatcatcgaaccacagacacataccacgagccaactgaccctacatacggaaactggaacggacctgagtactctacgacgacgacggtccttatattatgtacgngganagactaaatccctacttaacataattacgacgtataggaagttcgacttttacg

SEQ ID NO: 436389 - DNA, 681 bp, Homo sapiens
  misc_feature: GZ8MTXP02FSV68.38.25.C03.1.454.CMB.2.raw
  modified_base (413)..(413): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacgaagggctggagtggagtgggatggatcagctacttacaatacggaaaacacgaaaagtactgacaacattaaacgtttcccgaggggtacaggacgtcagttaccatacgaccanaacgacaacactaccgaacgagtacacgtcgaccctagaacgtacggaaaccttagggaaacggtaacccgtagacgtacgtacgtacgaaccgtaccgaaccggttacctttaattaacgttagtttacggtacgacgggtaaagtaaacggtaaacctttaaaacgtttaccccttaaacctttaacgtaaaactttaaccgtttaaaccggtaaaccgttaacggttaagggttaaaacggtttcggttaacgtttttttaaccg

SEQ ID NO: 436390 - DNA, 588 bp, Homo sapiens
  misc_feature: GZ8MTXP02H4WOA.38.25.C03.1.454.CMB.2.raw
  modified_base (405)..(405): a, c, t, g, unknown or other
  modified_base (468)..(468): a, c, t, g, unknown or other
tcagtcgatcacgtcacgaccggtgctcgatttagtagtgtagatttgggtttggggacccaaaaaccacacccctcccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctggttactactttagctagttatggtgtcagcgtgggtgcgacacgggcccctggacgaagggcttggaggtggagtgggatggatcgagcattacaataggaaacaacgaaagtatcgacaactattaactttccgaagggcagagtcatcatacgaccaanacgaacacactaccacgacgtacacgtacgaccctacatacggaactaggaacgaaccgtganacgtcgtacgaacgacacggtaccttatatttagtcggtagacgtagaacaacgttaaacttacctacttaacgacttaacgttaacgaacgtagtaggtaaacttcggttacttttacg

SEQ ID NO: 436391 - DNA, 682 bp, Homo sapiens
  misc_feature: GZ8MTXP02HHKZQ.38.25.C03.1.454.CMB.2.raw
  modified_base (371)..(371): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttagtggtgtcagtcgtgggtcgcgacgacggccccgtaggaccgaagggtcttggagtggagtgggactggatcgagctaacttacaagtaggaaaacacgaaagtntacgacataactaactttcgagggtacaggtactacaatcaagtacgaaccaacacgaacaactactaccgaacgacgacctaccgggtcaaccctaagtacgttacggaaacgtaacggaaaccggtaaccgttaggaacgtacgtttaccgacgaaccggtaaccgtaccggttaacctttaaggttactttaagttcggtagacgaaaggtaaactaaaccgttaaacttacccttacttaaacgtaaacttaacggttaaaacccggacgtaacggtaaggttaacgttacggtttactttttaacg

SEQ ID NO: 436392 - DNA, 529 bp, Homo sapiens
  misc_feature: GZ8MTXP02GO24V.38.25.C03.1.454.CMB.2.raw
  modified_base (470)..(470): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgttcagctgggtgcgacaggcccctggacaagggcttgagtggagtgggatggatcagcacttacaaatggaaaacacaaaagtatgacacataaatttccagggcagagtcagtcatgaccacagacacatccacgagcactgctacatgaactgacggactagacgatctagacgacacggtacttatattatgtgacganacgtacaaattcctacttaacactaagttacgaacgtacgtggaaacgtgtacttttaa

SEQ ID NO: 436393 - DNA, 767 bp, Homo sapiens
  misc_feature: GZ8MTXP02JDGTG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacacggcccctggacgaagggcttgaggtggagtgggatggatcgagctacttaacaagtaggaaaacaacgtaaagtatacgacctaacgtaattaaacgtttacccggaaggggtaccaggtaacgttacaagttaccaacgttacggaaacccaacgaaacggaaccaaacctaaccgtacccgaaacggaacgaccctaaaccgttcggtaaccccttaagacgttaacgggaaaaccgttagggaaaccgggtaaacccgttagggaacgtaacgtttacccgacggtaaacccggaaccgtaacccggttaacctttaagttaacgtttaacggttggtacggaccggtaaaggtaaaccgttaaaaccttaaaacgtttccccttaaaacccgttaataacgttaaaccgtttaaccggaaacggttaacgttacgggtttaaaacggttttcggtttttaactttttaaccgg

SEQ ID NO: 436394 - DNA, 549 bp, Homo sapiens
  misc_feature: GZ8MTXP02HRR3F.38.25.C03.1.454.CMB.2.raw
  modified_base (374)..(374): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggagtgggatggatcagcacttacaataggaaacacaaagtatcgacacataactttcagggcngagtcatcatgaccacagacacataccacgagcactgacctacatggaactgaacggaacctgagatctgaacgacgacggccttaatattattggtgacgtagaacgtaactaaacttcctaccttaacattaacttaacgacgtacgtaggtaacgttagttacctttttaag

SEQ ID NO: 436395 - DNA, 569 bp, Homo sapiens
  misc_feature: GZ8MTXP02F2Z3I.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgacccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcagcacttacaagtaggaaaacacaaaagtatacgacactataaatttccgaggggcagagtcaattcatacgaccacagacacataccacgagacactcgacctacatggaaactagaacggaacctgaagactctacgacgacacgggtacctttaagtattagttaggtagacgaagacgtaactaaactttccctacttactaactaagttaaccgacgtacgtaggaacgtgtacttttacg

SEQ ID NO: 436396 - DNA, 589 bp, Homo sapiens
  misc_feature: GZ8MTXP02HTCRQ.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgacggcccctggacgaagggcttggagtggagtgggatggatcagcactttacaatggaaaacacaaaagtatacgacaactaataactttccgaaggggcaggtagtacatccaatcgaaccacacgaacacactacaacgagcaacctgacctacagtacggaaacttgaacggtaactagaagtactacgtacgaacgaacgtaccggactttaataatttagtgtagacgtagaacgaacttaaacttccctaacttacaattaagtaaccgagtaactggtaaaggtctttactttac

SEQ ID NO: 436397 - DNA, 640 bp, Homo sapiens
  misc_feature: GZ8MTXP02IDS9W.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggagggccgtggggcctcagtgaacgtctcctgcaaggctttctggttactactttttagcagtttatggtgtcaggtcgtggggtgcgacgacggcccctgggaccgaaggggtcttggagtggagtggggatggatcaggctacttaacaagtaggaaaacacgaaagtatcgacaactattaaactttccgaaggggctagggacttacaattccaattcgaaaccaacaacgaaccacactacccaacgagacacctcgaccctacagtaggaaacctaggaacggaacctaggacgtattaccgagaaccgacgtaccggtacctttaataagtttattgttacgaacggaggaaacgtaactaaaactttccctaacctttaacagttaacttacggaacgtaacgtaggtaaagttcgttacttttaacg

SEQ ID NO: 436398 - DNA, 623 bp, Homo sapiens
  misc_feature: GZ8MTXP02JP88Y.38.25.C03.1.454.CMB.2.raw
  modified_base (320)..(320): a, c, t, g, unknown or other
  modified_base (414)..(414): a, c, t, g, unknown or other
  modified_base (447)..(447): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtaccaacaaataagaattacttcgcttggtaccagcaagaaaccaggacacgcctacctaagttgctctatttacgnggcatccgtaccgggacgtccggggtccctagaccgtattccgagcggacaggccgggtctggacgactagtactttcgactctaccgaacctntaccagcacgccctgcgaggctagaagtatggnggacttagtttattcgagtacagtacgtaagtttattaacgtagttaccgtaccttacgtacggtttaccgggtttccggggaacccgggggtaactaaacgggtccggtaacgggtaaggacttaaccggaaaacggtacgttaggtacggtaccgttacggaacccttaacccg

SEQ ID NO: 436399 - DNA, 555 bp, Homo sapiens
  misc_feature: GZ8MTXP02I6AFA.38.25.C03.1.454.CMB.2.raw
  modified_base (391)..(391): a, c, t, g, unknown or other
  modified_base (404)..(404): a, c, t, g, unknown or other
  modified_base (409)..(409): a, c, t, g, unknown or other
  modified_base (417)..(417): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaaacaggtgcccactcccaggttcaattggtgcagtctggagctgcggtgaagaggcctggggcctcagtgaacgtctcctgcaaaggcttctggttacactttttagcagttatggtgtcagctgggtgcgacaggccccctggacaagggcttgagtgatgggatggatcagcacttacaatggaaaacacaaaagtatgcacataaatttccagggcagagtcatcatgacacaanacacacacacganacacncgacacanagacgagagaacgtagagatactacgacgacgacgtacttattaattattagtagacgagaacgaaactaaacttaccttaccttaactaacttaacgttaacgtaacgtaacgtaaggtaacgtacgttactttacg

SEQ ID NO: 436400 - DNA, 647 bp, Homo sapiens
  misc_feature: GZ8MTXP02GOGT7.38.25.C03.1.454.CMB.2.raw
  modified_base (400)..(400): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaaacacaaaagtatgacaactaataaactttccgaaggggcaggtagtcatcaatgaacccanaagacaacatccacgagcaactgaccctaacagtacggaaacctgaacggaaccctagaacgatacgtacgaacgaacgtaaccgggtacctttaagttaatttagttaggttaggaccggaaaggtaacggtaaaacctaaaacgttttacccccttaacctttaaacctaaactttaaagtttaaaccggaaaccggttaaacgttacgggggtaaaaactttcgggtttaaccttttttaaacg

SEQ ID NO: 436401 - DNA, 643 bp, Homo sapiens
  misc_feature: GZ8MTXP02IKPYZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtctgggtgcgacaggcccctggacgaagggcttggagtgggatgggatggatcgagctaacttacaataggaaaacacaaaagtatgacaacattaactttccgaaggcagagtcatacatacgaacctacagacacactaccacgacgcactcgtacctaacacgtacggaaacttacggaacggtaaacccgttaggaacgtacgtaccgtacggaaaccgtaaccgtaacggggttaccctttaaagttaacgtttaacgtttacggtacgtacggtaaacgaacgtaaaacttaaaacctttccctaacctttaacactttaaacgtacgaacgtagtacggtaacgttacgtacgtttttaacg

SEQ ID NO: 436402 - DNA, 746 bp, Homo sapiens
  misc_feature: GZ8MTXP02FKWIB.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcagcacttacaagtaggaaaacaacaaaagtatacgacaacgaattaaacgtttcccgaaggggtaccaggacgtactaattaccatacgaaaccaacgaacgaaaccaacaactacccaacggacgaccaaccgtcgacccttaacgaacgttacggaaaccgtacggaaacggtaaaccccgtaggaagtacgtaccgtaacggaaccgtaaccgaaccgggttaaccctttaaagttaaacgtttaaacggtttggttaacgggaaccgggtaaaggggtaaaaccgtaaaaccgtttaaaaaccgtttcccccgtttaaaccctttaaaccgttaaactttaaaacggtttaaaacccgggtaaacgttaaaacggttaacggggttaaacggtttacggtttaacccgtttttttaaacg

SEQ ID NO: 436403 - DNA, 727 bp, Homo sapiens
  misc_feature: GZ8MTXP02F0QC6.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgacggcccctggacaagggcttgaggtggagtgggatggatcagcacttaacaatacggaaacaacaaaagtatacgacaactaattaaacgtttccgaaggggtacaggagtacaattacaatacgaaaccctaacaacgaaacaaaccaactaccccgaacggaacgaccaacctacgacccttaacgaacgtacggaaaaccgttaggaaacgggtaaaccctaggaacgtaacgttaccgttaaccggaaccggtaaccgtaaacccggggtttaccctttaaacgttaaacgttttaaggtttacggtacggtaacccggtaaaggtaaaccggtaaaaacgtaaaacctttttaccccgttaacccctttaaactaaacgttaacgtttaaacgtaaaccgtacgttaaggtaagtttacggttactttttaaacg

SEQ ID NO: 436404 - DNA, 649 bp, Homo sapiens
  misc_feature: GZ8MTXP02G0YAW.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgacaaggtcttcgttggttactacttttagctagttatggtgtcagcgtgggtgcgacgacggcccctggacgaagggtcttaggagtggagtgggatgggatcgagcaacttacaagtaggaaaacaacaaaagtatccgactaacgtaattaaactttccgaaggggacagacgtacatacgatacgaaccaacaagacaacactacccgacgaacgcactacgaccttaacgagtacggaaactaggaaacggtaacccgtaggaacgagttaccgaggaaccgaccgtaacggtacctttaaattagtttagtacggttaggacgtaaggaaactaaacgtaaaaccttcccttaacttaacctattaaacgttaccggaacgtaactaggtaacgtttacgtacttttaacg

SEQ ID NO: 436405 - DNA, 669 bp, Homo sapiens
  misc_feature: GZ8MTXP02JNZII.38.25.C03.1.454.CMB.2.raw
  modified_base (364)..(364): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttcgtggttactacttttagctagttatggtgtcagcgtgggtgcgacgacggccccgtggaccgaagggcttggaggtggagtgggatggatcgagcacttacaagtaggaaaacacaaagtntacgacaactaattaacgtttaccgaagggaccaggtaacgtactacgttaccaagttacggaaacccaacaaacgacctaaacccactacccgaacggacgacctacctacgacccttaaccgagtacgggaaaccgtgaaacgggtaaccctaggaagtacgtacgtacgaaccgaaccgtacggttaccttaattagtttagtagtacggacgaaaggtaacgaaccttaaactttccctaccttaagtaacttaacgtaaacgtaaccggtaagtacggtaagtcgtttacgtttttaacg

SEQ ID NO: 436406 - DNA, 601 bp, Homo sapiens
  misc_feature: GZ8MTXP02GHKO7.38.25.C03.1.454.CMB.2.raw
  modified_base (420)..(420): a, c, t, g, unknown or other
  modified_base (430)..(430): a, c, t, g, unknown or other
  modified_base (454)..(454): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcaggtcgtgggtgcgacgacggcccctggacgaagggcttgaggtggagtgggatggatcgagctacttacaaagtacggaaacaacgaaaagtatacgacaacaattaactttaccgaggggtacagagtcaatcatacgaccaanacgacacacnccaacgacgtcactacaccctaanagtacgaaacgtaggaaacgacgtagagacgtacgacgacgacgtacgtacttattagttagtgtacgacgaagactaaacttaacttaccttaacctaataacttaacgtacgtaacgtacgtaaggtacgttacttacgtttacg

SEQ ID NO: 436407 - DNA, 661 bp, Homo sapiens
  misc_feature: GZ8MTXP02GP4EP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactacttttagctagttatggtgtcagtcgtgggtgcgtacgacggtccccgtaggacgaacggggtcttaggaggtggaggtaggggattgggactcgaacggtcctaacgtttaacaaagtaacgggaaaacaaacgtaaaagtatacgacaacgtaattaacgtttaccgagggtacagggtactacactcagtacgaaccacaacgacaacaactaccgaagaccgacaccgtcgacctaacacgtaggaacgttacggaaacggtacgtaggactacgtacgtaccgaacgaccgtaaccggtacttaagttattagttggtacgacgtaaagacgtaaaacttacgttacctaccttaacttacgttaacgtaacgaaccgtaagtaggtaacgtctacttttacg

SEQ ID NO: 436408 - DNA, 667 bp, Homo sapiens
  misc_feature: GZ8MTXP02FHND9.38.25.C03.1.454.CMB.2.raw
  modified_base (488)..(488): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttatggtgtcagcgtgggtgcgacgacggccccgtggacgaagggcttggaggtggagtgggatggatcgagctaacttaacgaagtaacggaaaacaacgtaaaagttatacgactaactaaattaaacgtttaccgaaggggacaggtacgtactaagtacaatacgaaacccaaacaacgaaccaacactacccgaacgacgaccaccgtacgaccctaanaaacgtacgggaaacgtacggaaacggtaacccgtaggaacgtaacgtacgtacgaaaccggtaacgtacggtaccttaagttaatttagtaggtcgacggaagacgtaaactaaacttcccttaactaactaattaacgtaacgtaacgtacgttaggtaagtacgttacttttaacg

SEQ ID NO: 436409 - DNA, 562 bp, Homo sapiens
  misc_feature: GZ8MTXP02JYTJU.38.25.C03.1.454.CMB.2.raw
  modified_base (307)..(307): a, c, t, g, unknown or other
  modified_base (314)..(314): a, c, t, g, unknown or other
  modified_base (366)..(366): a, c, t, g, unknown or other
  modified_base (370)..(370): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgtttacacaggtccaaacaataagtaattacttcgcttggtaccagcagaaaccaggacagcctcctaagtgctnatttacngggcatcgtacccgggagtccggggtcctgaccgactcagcgcaggcggtcngganacagtattcgactctcacatcagcagcctgcaggctagacgagtgtaggctagtttatactgtacagctagtattagttagtacgtaccctagtacgtacggtttacggggacccgggggtaactacggaccgttagggaacgtaacgtaaccgtaaaacggacgtacggtacgaccgtacggacctaaccg

SEQ ID NO: 436410 - DNA, 566 bp, Homo sapiens
  misc_feature: GZ8MTXP02HXOEZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgacggcccctggacgaagggcttgagtggagtgggagtggatcagcacttacaataggaaacaacaaagtatagacacaataatttcgaagggtcagagtcatcaatcgaccacagaacacaatacccacgagaccaactcgaccctacagtacggaaacctggaacggaacctgaagatcgtagacgacaccggtactttatatttatgtgacgagaacgaactaaactttcctacttaacattaacgttacgacgtagtggaaacgttgtacttttacg

SEQ ID NO: 436411 - DNA, 546 bp, Homo sapiens
  misc_feature: GZ8MTXP02JERRG.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagtgctcattactgggcatcgtacccgggacgtccggggtcctgaccgacttcagcgcagcgggtctgagacagtattcactctcaccatcagcagccctgcaggctagaagtagtagtggtctagttttatacttggttcagctagtattatagtacgtctactacgtacgttttggggacccggggtacaacggtctacgggagtaacgtaaccgtaaaacgacgtacgtaggtctcggacaaccg

SEQ ID NO: 436412 - DNA, 587 bp, Homo sapiens
  misc_feature: GZ8MTXP02IZ6P2.38.25.C03.1.454.CMB.2.raw
  modified_base (424)..(424): a, c, t, g, unknown or other
  modified_base (447)..(447): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcgagtcgtgggtgcgacacggccccgtggaccgaagggtcttgaggtggagtgggatggatcgagctaacttacgaagtacggaaaacacaaaagtatcgacactaattaacttcgagggcagagttacatcatacgaacacaagactacganaccaacgacgacactcaccctanagtcggaaactgggaacgaacgtgagattacgagacgacgaccgtactttatagtattcggtagacgtaagaacgtaaccttaaacttccctaacttactaagttaactaccggatacgtaggtaatcgttacttttacg

SEQ ID NO: 436413 - DNA, 565 bp, Homo sapiens
  misc_feature: GZ8MTXP02I03I5.38.25.C03.1.454.CMB.2.raw
  modified_base (393)..(393): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacgaagggcttggagtggagtgggatggatcagcacttacaatacggaaacacaaagtatagacacataacttccagggcagagtcatcatagaccanagacacataccgacgagacactgcctacagtaggaactggaacgactagagatacgtagacgacgacggtacttagttattattgtacgacgtaagaacgtaactaaactttccctaccttaactaattaacgtaacgtaacgtacgttaggaaacgtttgtacttttaacg

SEQ ID NO: 436414 - DNA, 643 bp, Homo sapiens
  misc_feature: GZ8MTXP02GLJ1B.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacacggcccctggacagggcttgaggtggagtgggatggatcgagcacttacaagtaggaaaacacaaagtatacgacaactaattaacgtttaccgaggggaccaggtacgtaccaagtaccaagtacgaaaccaacaacgaaccaaacactacccgaacgaacgaccaacctcgaccctaacgacgtacggaaacgtggaaacggtaaccgtagaagtacgtcgtacgaacgaccgtaacggtaccttaagttatttaagtcggtacgacgaaggtaactaaacctaaaactttcccctaacttaactaagttaacgttaacgaacgtagtacggtaagttcgttactttttaacg

SEQ ID NO: 436415 - DNA, 679 bp, Homo sapiens
  misc_feature: GZ8MTXP02FZDEZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttatggtgtcagcgtgggtgcgacacggcccctggacgaagggcttggagtggagtgggatggatcgagactaacttaacaaagtaggaaaacaacgaaaagtactagactaactaattaaacgtttccgaagggcaggtagtactaatacaatacgaaccaacaacgaacaacaactaccaacgaacgaccacctacgaccctaacgaacgtacggaaaaccgtaggaaacggtaaaccgtagaacggtaactacgtaacggaaccgtaaaccgtaaccggttaacctttaataatttaagttggtaacggacggtaaagaacgtaaaaccttaaaacgtttacccttaaccttaactaaacttaacgttaaccgtaaacgtaaacgtaggtaaagttacgttactttttaacg

SEQ ID NO: 436416 - DNA, 530 bp, Homo sapiens
  misc_feature: GZ8MTXP02H4PKD.38.25.C03.1.454.CMB.2.raw
  modified_base (448)..(448): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaaacacaaaagtatgacactaataactttaccgaggggacagagtctaatccatagaccacagacacatccacgagcactgacctacatggaaactgagacctgagatacgngacgacacggcttatattatgtgacgagagaactaacttcctacttaacataagttacgacgataggaacgtgtcttttaag

SEQ ID NO: 436417 - DNA, 663 bp, Homo sapiens
  misc_feature: GZ8MTXP02GWLSU.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgacggcccctggacgaagggtcttggagtggagtgggatggatcgaggcacttacaagtaggaaaacacgaaaagtatacgacaactattaaactttccgaaggggtacaggacgtacatactagtacgaaccaacgtagaccaacactacccaacgacgacaccgtcgaccctaacagtacggtaaactggaaacggtaaacccgttgaagtacgtaccgtaacggaaccgaaccgtacggtacctttaagttagtttaacgttggttacggaccggaaagtaacgtaaacttaaaaccgtttcccttaccctttaacgtaattaaccgtttaacgaaccgttacgttagggtaaaacgtttcgtaacgtttttaacg

SEQ ID NO: 436418 - DNA, 690 bp, Homo sapiens
  misc_feature: GZ8MTXP02JUY0E.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggcttggagtggatgggatggatcagcacttacaatggaaaacacaaaagtatacgacaactaattaaactttccgaaggggcaggacgtacatacgaatcgaacccacagaccacactccgaacgagcactcgacctaacgatacggaaacgtggaaacggaacccgtgaacgtactacgtcgaaaccggtaccgtacgggtacctttaaagttactttaacgttaggtacggtaccggtaaaggtaaaccggtaaaaccgttaaaaaccgttttccccttaaacccggttttaaaacgtaaacttttaaaccggtttaaaaccggtaaaaccggttaaacggtttaacgggggtaaaacgtttaccgggttaccgtttttttaaaccg

SEQ ID NO: 436419 - DNA, 701 bp, Homo sapiens
  misc_feature: GZ8MTXP02JXOHM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacgaagggcttgagtggagtgggagtggatcgagcacttacaataggaaaacaacaaagtatcgacaacataatttccgaagggcaggagtacatacatacgaccacaacgacacactacccacgacgacactcgaccctacagtacggaaactacggaacggaacccgtagaacgacgtaccgtacggaaccggaaccgtaaccggggtaccctttaaagttaacgtttaacgtttagggttacggtaccggtaaagggtaaacggtaaaaccttaaaaccgttttaccccgtttaaccctttaaaaccgttaaactttaaaaccggtttaaacccgggtaaaccggttaaaacggtttaacggggttaaaacggtttaccggtttaaccttttttttaaacccgg

SEQ ID NO: 436420 - DNA, 513 bp, Homo sapiens
  misc_feature: GZ8MTXP02HULHQ.38.25.C03.1.454.CMB.2.raw
  modified_base (451)..(451): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcacttacaatggaaaacacaaagtatcgacacataaattcagggtcagagtcatcatgaccacagacacatccacgagcactgcctacatggaactgagaactgagatctgacgacacggtcttatnttatgtgacgtagacgactaaacttcctactacattaatacgacgtatagaagtctacttta

SEQ ID NO: 436421 - DNA, 597 bp, Homo sapiens
  misc_feature: GZ8MTXP02F46T5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttgagtggagtgggatggatcgagcacttacaagtaggaaaacacaaaagtatagacaactaattaaacgtttccggggacagagtcaatcatgaaccacagacacactccaacgagcactcgacctagatacggaaactaggaaacgaaacctaggaagtacttacgacgaaccgaccgtacggtacctttaaatatttaagttcggtagacgagaacgtaaactaaacttcccttaccttaacattaacgttaacgaacgtacgtacggaagttacgtactttaacttttcg

SEQ ID NO: 436422 - DNA, 584 bp, Homo sapiens
  misc_feature: GZ8MTXP02H9WQK.38.25.C03.1.454.CMB.2.raw
  modified_base (398)..(398): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactaccaggttcaattggtgcagtctggagctgcggtgaagaggcctggggcctcagtgaacgtctcctgcaaggcttctggttacacttttagcagttatggtgtcagctgggtgcgacaggcccctggacaagggcttggagtggagtgggatggatcgagcacttacaatggaaacacaaagtatacgacacataatttcagggcagagtcatcatcgacacacgacacanccacgagcactcgacctacagtacggaaactggaacggaaccttgaagtactacgtacgaaccgaccgaaccgggtcctttaaattagtttaattcggttcgacggagaacgtaaccttaaacttcccttaccttaactaacttaacgttacgaacgtactagggtaacgttagttacttttaacg

SEQ ID NO: 436423 - DNA, 513 bp, Homo sapiens
  misc_feature: GZ8MTXP02FIA94.38.25.C03.1.454.CMB.2.raw
  modified_base (453)..(453): a, c, t, g, unknown or other
  modified_base (479)..(479): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctggggtgcgacaggccccctggacaaggggcttgagtggatggggatggatcagcacttacaatggaaacacaaagtatgcacataatttccaggggcagagtcatcatgaccacagacacatccacgagcactgcctacatggaaactgaggaacctgagatctgacgacacggcctanattattgtgcgagagacaaaattccnccttacataattacgacgatggaaagtgctttaa

SEQ ID NO: 436424 - DNA, 639 bp, Homo sapiens
  misc_feature: GZ8MTXP02ILH86.38.25.C03.1.454.CMB.2.raw
  modified_base (350)..(350): a, c, t, g, unknown or other
  modified_base (444)..(444): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacgaagggcttaggagtggagtggggatgggatcgagctacttacaataggaaacanaaaagtatacgacactaattaactttccgaaggggcaggagtacatcatcgaaccacacgacaacactacccagacgacacgtacgaccctaanacgtaggaaaccgttaggaacggtaacccgttaggaacgtacgtaccgtacggaaccgacgaaccgggtacctttaatagtttaagttcggtacgacggtaaaggaaactaaacttaaactttaccctaccttaaactaagttaacgtttaacggaacgttaacgtaggttaacgttacggttaactttttaacg

SEQ ID NO: 436425 - DNA, 596 bp, Homo sapiens
  misc_feature: GZ8MTXP02H5FL3.38.25.C03.1.454.CMB.2.raw
tcagtcgatcacgtcacgaccggtgctcgatttagtagtgtagatttgggtttggggacccaaaaaccacacccctcccttgggagaatccccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggccccctggacaagggcttggagtggagtgggatggatcgagctattacaagtaggaaaactacaaaggtatcgacaactataattccgagggacagagtacagtacatacgacacaagacacactccaacggatcaactcgacctacagtacggaaaccttaggaacggaaccgttagaagacgtacgtaggaaaccgacgaaccgggtccttaaagtattagttgtacgacgtaggaacaactaaacttccctaccttaactaattaacgttacgaacgtagtaggtaagtcggttactttacg

SEQ ID NO: 436426 - DNA, 602 bp, Homo sapiens
  misc_feature: GZ8MTXP02ISJ6P.38.25.C03.1.454.CMB.2.raw
  modified_base (351)..(351): a, c, t, g, unknown or other
  modified_base (376)..(376): a, c, t, g, unknown or other
tcagtcgatcacgtcacgaccggtgctcgatttagtagtgtagatttgggtttggggacccaaaaaccacaaccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgagtggatgggatggattagcacttacaataggaaacacaaagtangaccacataatttccgagggcaagngtcatcatcgacacagacacatccacgagaccactcgacctacagtaggaactaggaacggaaccgtaggaagtacttcgtacggaaccgaaccgtaccgggtacctttaattatttaagttaggtcgtaacggaagtaacgaaactaaaactttacccttacctttaaactattaaacttaaccgaacgtaagttacggtaaagttcgttacttttatttttacg

SEQ ID NO: 436427 - DNA, 571 bp, Homo sapiens
  misc_feature: GZ8MTXP02GQ20G.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacagggcttgagtggagtgggatggatcgagcacttacaataggaaacacaaagtatacgacactataactttccgaggggcagagtcatcatacgaaacacaagacacactaccacgacgacactcgacctacatacggaactggaaggaacctagagactcacgacgacgacggtacttatattagtgtacgacgtaagaacgtaactaaacttcccttaccttaactaacttaacgttaacgaacgtacgtaggtaacgttgtacttttaacg

SEQ ID NO: 436428 - DNA, 575 bp, Homo sapiens
  misc_feature: GZ8MTXP02JS2O5.38.25.C03.1.454.CMB.2.raw
  modified_base (398)..(398): a, c, t, g, unknown or other
  modified_base (466)..(466): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacgaagggtcttggagtggagtgggatggatcagcacttacaataggaaaacacaaagtatgacactaattaattccagggcaggagtcatcatcgaccanagacactacaccacgagaccactacgacctacagtaggaaactggaaacggaacctaggatagtacgngaaccgacgaaccgggtccttaagttaatttagtaggttcgaggagaagtaacctaaacttccctaacttacaattaataaccgagtactaggacgttatacttttacg

SEQ ID NO: 436429 - DNA, 635 bp, Homo sapiens
  misc_feature: GZ8MTXP02GHHO4.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttatggtgtcagcgtgggtgcgacgacggccccctggaccgaagggcttggaggtggagtgggatggatcgagcacttaacaagtaggaaaacaacgaaagtatcgacaactaattaaacgtttcccgaaggggcaggacgtacatacaatacgaaccaacacgaacaacactaccacgaacgtccaactacgaccctaagacgtaggaaactggaaacggtaacctaggagaacgttacgacgaacgaccgtacgggtacctttaagttatttaagttcgtaggacggagaaacgtaaactaaactttaccctaccttaactaattaacgtaacgtaacgtacgtaaggtaaagttcggttacttttacg

SEQ ID NO: 436430 - DNA, 574 bp, Homo sapiens
  misc_feature: GZ8MTXP02FQIM1.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaataggaaaacacaaaagtatacgacaacaattaaatttccgaagggacaggagtcaatcatgaaccacagacacactaccaacgagacactcgacctaacatcggaaactggaacggaacctgagatctagacgacgacggtacttataattatgtagacgaagacgaaactaaacttcccttaaccttaactaacttaacgttaaccgaacgtaacgtaggtaaacgtgtactttttaacg

SEQ ID NO: 436431 - DNA, 529 bp, Homo sapiens
  misc_feature: GZ8MTXP02FTTDQ.38.25.C03.1.454.CMB.2.raw
  modified_base (412)..(412): a, c, t, g, unknown or other
  modified_base (429)..(429): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaaacacaaagtatgcacataatttccagggtcagagtcatcatgaccacagacacactccacgagcactgacctanatgaactgagacctganatctgacgacgacggtaccttatattattgtacgacgagagtaacaacttccctaccttacaataagttaacgacgtagtaggtaaagtcgtacttttaa

SEQ ID NO: 436432 - DNA, 629 bp, Homo sapiens
  misc_feature: GZ8MTXP02H1IXJ.38.25.C03.1.454.CMB.2.raw
  modified_base (363)..(363): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacaagggtcttggagtggagtgggatggatcagcaattacaaagtaggaaaacacgaaaagttanacgacaactaattaaacgtttccgagggacaggagtacaatcaatcgaaaccacgaagaccaacaactccgaacgacgacctacgtacgacctactaagtacggaaaccgtagaaacggtacctagacgtattacgacggacgacgtacggtactttaatagttatggtacgacggtaaggaactaaactaaaactttccctaaccttaaataacttaagttaaccggaacgttacgtaggtaaacgtttcgttacctttttaacg

SEQ ID NO: 436433 - DNA, 575 bp, Homo sapiens
  misc_feature: GZ8MTXP02JH488.38.25.C03.1.454.CMB.2.raw
  modified_base (505)..(505): a, c, t, g, unknown or other
  modified_base (530)..(530): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatgggatcgagcaacttacaagtggaaaacacaaaagtatagacaacaataattccgaagggcagagtcatcaatcgaaccacaacgacaacaactccaacgacgtacactcgaccctaacatacggaaactgaacggaacctgaacagtacagacgacacggtccttaattattagtcgtgacggaanaacgtactaaacttcctaccttaanaacttaattaaccgaacgtaactaggtaacggtctactttttacg

SEQ ID NO: 436434 - DNA, 551 bp, Homo sapiens
  misc_feature: GZ8MTXP02HGH53.38.25.C03.1.454.CMB.2.raw
  modified_base (389)..(389): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatggggatgggatcagcacttaacaataggaaaacacaaagtatgacacataattcaggcagagtcagtcatacgacanagacacatccaagagcaactcgacctacatggaaactgaacggactgagactacacgacgacgacgtaccttaatattaagtgtagacggatacgaaactaaaacttcctaacttacaattaagttaaccgaacgtagtacgtaaggtacgttacttttaag

SEQ ID NO: 436435 - DNA, 571 bp, Homo sapiens
  misc_feature: GZ8MTXP02GIQXI.38.25.C03.1.454.CMB.2.raw
  modified_base (427)..(427): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttggagtggagtgggatgggatcgagcacttacaagtggaaaacacaaagtatagacactataacgtttccgagggcagagtcatcatcgaccacaagacacatacccagagcactgccctaaanacgtacgaactagaacggactagagacgtacgacgaacgacgtacggtacttaagtacttagtgtacgacgaagacgaacttaacttacccttacttaactaattaacgtacgtacgtacgtaggtacgttacgttactttacg

SEQ ID NO: 436436 - DNA, 541 bp, Homo sapiens
  misc_feature: GZ8MTXP02JXA18.38.25.C03.1.454.CMB.2.raw
  modified_base (416)..(416): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaacacaaagtatacgacacataaactttccagggcagagtcatcatgaccacagacacatccacgagcactgaccctanatacggaactgagacctgagatacgtgacgacacggtcttaagtattatgtcgacgaagacgaactaaacttccctaccttaacattaacgtaccgtaacgattaggaaacgttgtacttttaac

SEQ ID NO: 436437 - DNA, 663 bp, Homo sapiens
  misc_feature: GZ8MTXP02HRSKY.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacgacggcccctggacgaagggcttggaggtggagtgggatggatcagcacttacaagtaggaaaacacaaagtatcgacaactaattaaactttcgaagggtcaggtagtacatcatacgaaccacaagacacactaccgaacgacgaccaactcgaccctaacagtacggaaacttaggaaacggtaaacccttaggaacgtacgtacgtacggaaaccggtaaccgtaaccgggtaaccctttaagttaacgtttaacgtttggtacggtacgaaggtaaacgtaaaccttaaaactttcccttacctttaaactaacgttaaacgtttaaccggaacgttaaggtacggttaaagttcggtttaactttttaacg

SEQ ID NO: 436438 - DNA, 558 bp, Homo sapiens
  misc_feature: GZ8MTXP02GHRZJ.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagattactcgcttggtacaagcaagaaaccaggacagcctcctaaagttgctcatttacgtgggcatccgtacccgggagtccggggtccctgaccgacttcgagcggcaggcgggttctggagacagtactttcactctcaccatcagcacgcctgcgaggctagaagtagtggtggctagtttattactgtcagactagtattatagttacgtctacgtacgtacgtttcggggaccggggtaccaaggtcgtacggagacgtaacgaaaacggtaacgtggtacggtactacggacctaaccg

SEQ ID NO: 436439 - DNA, 555 bp, Homo sapiens
  misc_feature: GZ8MTXP02FQ27H.38.25.C03.1.454.CMB.2.raw
  modified_base (386)..(386): a, c, t, g, unknown or other
  modified_base (415)..(415): a, c, t, g, unknown or other
  modified_base (440)..(440): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacaagggcttgagtgatgggatggatcagcacttacaatggaaaacacaaaagtatgcacataactttccaaggcagagtcatcatgaccanagacacataccagagcaactgaccctaanactacggactagaacggtactaganactcgacgacgacgacgtacttatattagtgtacgcgaagaacgtaaacctaaacttaccctaccttaactacgttaacgttaacgaacgtacgtaggtaactacgtactttaac

SEQ ID NO: 436440 - DNA, 726 bp, Homo sapiens
  misc_feature: GZ8MTXP02FODSL.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttgagtggatggggatggatcagcacttacaataggaaacacaaagtatgcaacataatttccagggtcagagtacatcaatgaccaacaagacaacactacccgaacgacgacactacgacccttaacgaattacgggaaaacttagggaaacgggtaaaccccgttaggaaagaacgttaccgttacgggaaaccggaaacccgtaaaccggggttacccttttaaactttaaacgtttttaaacgttttcggggtttaggtaccgggaaaacgggtaaagggtaaaaccctaaaaacgtttttaccccctttaaacccccttttaaaccttaaacgtttaaaaccgtttaaaccggttaaacccgggtaaacgtttaacgggggtaaaacggttacggtttaacccgtttttttaaaacg

SEQ ID NO: 436441 - DNA, 652 bp, Homo sapiens
  misc_feature: GZ8MTXP02HBMED.38.25.C03.1.454.CMB.2.raw
  modified_base (361)..(361): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacaggcccctggacaagggcttgagtggagtgggatggatcgagctacttaacaagtacggaaaacaacaaagttanacgacactaattaacgttacgaggacagtacgtactatacgatacgaaccaacaacgaccaaccacctaccggggacaacgacctacgtaccgtaccctaacgaacgtaacggtaaacggtacggaaaccggtaacgtagaacggtacgtacgacgaaccggtaaccgtacggttactttaagttaacgtttacgtacggtacggacgtaacgaacgttaaaccttaaaccttaccttaacctaactaagtaacgtacgtaacgtagtaggtacgttacgttacgtttacg

SEQ ID NO: 436442 - DNA, 493 bp, Homo sapiens
  misc_feature: GZ8MTXP02GLWMB.38.25.C03.1.454.CMB.2.raw
  modified_base (401)..(401): a, c, t, g, unknown or other
  modified_base (404)..(404): a, c, t, g, unknown or other
  modified_base (408)..(408): a, c, t, g, unknown or other
  modified_base (445)..(445): a, c, t, g, unknown or other
  modified_base (490)..(490): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacaggtccaacaataagaattactcgcttggtaccagcagaaaccaggacagcctcctaaagttgctcaatttactgggcatctacccgggagtccggggtccctgaccgattcagcgcagcgggtctgagacagatttcactctcacatcagcagcctgcagcnganatgngcagtttatactgtcagcagtatagtgtagtctgctnactttcggcggaggaccaaggtgagaatcgaagcgaacgtgtcgntcg

SEQ ID NO: 436443 - DNA, 548 bp, Homo sapiens
  misc_feature: GZ8MTXP02GMEWC.38.25.C03.1.454.CMB.2.raw
  modified_base (426)..(426): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcagcacttacaataggaaacacaaagtatacgacaactaataactttccgaaggggcaggagtacatcatgaccacagacacatccacgagacactcgacctanatggaaactgaacggaacctgagatcgtagacgacacggtaccttaatagttattcgtagacgagtacgaacaaacttcctaccttacattaagtacgaacgtatacggaatcgtactttta

SEQ ID NO: 436444 - DNA, 713 bp, Homo sapiens
  misc_feature: GZ8MTXP02IEA2B.38.25.C03.1.454.CMB.2.raw
  modified_base (344)..(344): a, c, t, g, unknown or other
  modified_base (448)..(448): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggcctggggcctcagtgaacgtctcctgcaaggcttctggttactacttttagctagttatggtgtcagtctgggtgcgacgacggcccctggacgtaagggtcttaggagtggagtgggatgggatcagcacttaanaagtaggaaaactacaaaagtatacgacaactaattaaacgtttaccgaaggggtcaggtacgttacacttaccgaatcgaaaccaacgacgaaccaactaacncccgaacggacgactaaccgtcgaccctaacgagttaacgggaaaccgttaggaaaccggaaaccgtttaggaacgtaagttaccgacggaaaccggaaccgtaccgggttaccttttaagttaaacgtttagttaggtacggtacgtaaacggtaactaaaacgttaaaaccttttacccgttacccttttaaaataacgttaaaacgtttaaccggtaaacgtaacggttaaggtaaggttttaacgtttaactttttaacgg

SEQ ID NO: 436445 - DNA, 594 bp, Homo sapiens
  misc_feature: GZ8MTXP02FOINV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacgacggcccccgtaggacgaaggggtcttggaggtggagtgggagtggatcgagcacttacaataggaaaacacaaagtatacgacaacattaactttccgaagggcagagtcaatcatcgaacacaagacacataccgaacgacgacacgtcgaccctacgagtggaaactggaacgactagagatcgacgaccgacacgtactttatattagttgtaggacgagacgtaaactaaacgtttcccttaacttactaaacgttaacgttaacccgaacgtacgtaggtaacggttacttagtttttacg

SEQ ID NO: 436446 - DNA, 562 bp, Homo sapiens
  misc_feature: GZ8MTXP02G27NT.38.25.C03.1.454.CMB.2.raw
  modified_base (413)..(413): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaaacacaaagtatagacactataatttcaagggcagagtcatcatgaccacagacacatccacgagcactgcctanatggaaactggaacgacctgagtactcgtacgaacgacgtacggacctttaagtagtttaattcggtagtacggagtaaacgtaactaaaactttccctaccttactaattaagttacgaacgtagtaggtaagttacgtacttttaag

SEQ ID NO: 436447 - DNA, 693 bp, Homo sapiens
  misc_feature: GZ8MTXP02JN432.38.25.C03.1.454.CMB.2.raw
  modified_base (367)..(367): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagctgggtgcgacaggccccgtggacaagggctggagtggagtgggatggatcgagactacttacaataggaaaacacgaaaagtatacgcaanataatttccgaggcagagtcatcatcgaccacagacacactaccacgacgctaacctacgaccctaacagttacgggaaactacggaaacggaaacccgttaggaacgtaacgtaccgttaacggaaaccgaaccgtaaaccgggttaccctttaaaagtttaacgttttaacgttaggtaacgggtaccggtaaaaggtaaacgggtaaaacccttaaaacgttttacccccgttaaaccgtttaaacctaaatttaaacgtttaaaacggaaaccggttaagtaaccgggggtttaaatttacgggtttaacttttttaaacgg

SEQ ID NO: 436448 - DNA, 665 bp, Homo sapiens
  misc_feature: GZ8MTXP02GYJ2R.38.25.C03.1.454.CMB.2.raw
  modified_base (460)..(460): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccccgtggaccgaagggtcttggaggtggagtgggagtggatcgagcacttacaagtaggaaaacacaaagtatacgacactaattaacttaccgagggcagtacgtacatcatcgaaccaacgaagacaacactacccgaacgaacgacaaccttcgaccccttaanaacgtacggaaaaccgtggaaaccggtaacctaggaacgtacttaccgaggaacccgaacgtaccggtactttaagttaacgtttaagttcggtacggacggtaagtaacgaaaaccttaaaactttccctaacctttaacgtaacttaagtttaaacccgaaacggtacgttaacgggtaagtttacggtttacctttttaacg

SEQ ID NO: 436449 - DNA, 682 bp, Homo sapiens
  misc_feature: GZ8MTXP02F22VC.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttcgtggttactacttttagctagttagtggtgtcagcgtgggtgcgacacggcccctggaaccgaaggggcttggaggttggagtggggatgggatcgagcaacttacaagtacggaaaacaacgtaaaagtatacgacaactaaattaacgtttaccgaaggggacaggtacgtcaaattccgaattacgaacccaaacgaacgaaccaacaactacccaaacaacgaccactacgaaccctaacgtaagtacgggtaaactacggaaacggtaacccgtagaacggtaactacgtacgaaccggtaacgtacccggtactttaataagtttacgtaggttacggacggtaaagtaacgtaaacttaaactttacccgttaacttaacgtaaacttaacgttaacgacgtagtaggaaacgtttcgtactttttaacg

SEQ ID NO: 436450 - DNA, 539 bp, Homo sapiens
  misc_feature: GZ8MTXP02IF6SA.38.25.C03.1.454.CMB.2.raw
  modified_base (305)..(305): a, c, t, g, unknown or other
  modified_base (315)..(315): a, c, t, g, unknown or other
  modified_base (347)..(347): a, c, t, g, unknown or other
  modified_base (384)..(384): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaaataagaattactcgcttggtaccagcaagaaaccaggacagcctcctaagtnctcatttacnggcatctacccgggagtccggggtcctgaccntcagcgcagcggtctgagacagtattcactctcacancagcagctgcagctgagatgtgctagtttattactgtcagacagttattaatagtagtcctctacgtacgttttcgggaccggggtaaccctaaaggccgtaggacgtaagtaaccgtaaaacggaacgtacggtaggtccttacgactaacccg

SEQ ID NO: 436451 - DNA, 685 bp, Homo sapiens
  misc_feature: GZ8MTXP02GLWVZ.38.25.C03.1.454.CMB.2.raw
  modified_base (370)..(370): a, c, t, g, unknown or other
  modified_base (632)..(632): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacgacgggcccctaggaccgaagggtcttggaggtggagtgggatggatcgagcaacttacaagtacggaaaacacgaaaagtntacgacaactaattaacttaccgagggacaggtacgtcatcatacgaaccacgaagacaaccactaccaacgacgacctacgtacgaccccttaagacgttaacggaaaccgttacgggaaaccgggtaaccttaggaacgtaaccgttacgaaccggaaaccgtaacgtacccgggtttaacctttaagttaacgttttagtaggttacggaaccggaaaggtaaccgtaaaaccttaaaacctttcccgtaacctttaanaatttaacgttaaaccgaacgttaagtacgggtaatttacgttactttttaag

SEQ ID NO: 436452 - DNA, 590 bp, Homo sapiens
  misc_feature: GZ8MTXP02G0BPW.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgagtggagtgggatggatcgagcacttacgaataggaaaacacaaagtatacgacacattaattcccgaagggtcagagtcattacatcgaaccacagaacacactaccaacgagaccactcgaccctaacgaattagggaaaccttggaaacggtaacccgtggaagactacgtacggaccgaccaaccgggtccttaagtaatttagtagtacggacgaagacgaaactaaacttccttacctacataacgttaacgacgtagtaggtaacgtgtcttttaag

SEQ ID NO: 436453 - DNA, 653 bp, Homo sapiens
  misc_feature: GZ8MTXP02JXU2K.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacacggcccctggacgaagggcttggagtggagtgggatggatcgagctacttaacaaataggaaaacaacgaaaagtatacgacaactaattaaatttcccgaaggggcaggacgtcatcatcgaccacagacaacatacccacgacgcactcgacctaacgacgtacggaaacgtaggaaccgggtaaacctaggacgtaacgtacgtacgaaccgaaccgtaaccgggtaccctttaaagttaacgtttaagttcggttacggaccggtaaagaaacggtaaaaccttaaactttaccctaacctttaaacctaagttaaccgttaacggaacgtacgtaggtaacgtttacgttactttttaacg

SEQ ID NO: 436454 - DNA, 674 bp, Homo sapiens
  misc_feature: GZ8MTXP02H5XS5.38.25.C03.1.454.CMB.2.raw
  modified_base (282)..(282): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgacgtctcctgcaaggtcttctggttactacttttagctagttatggtgtcagcgtgggtncgacacggcccctggaacgagggtcttaaggtggagtgggatggatcagcacttacaagtaggaaacaacgaaagtatagaccaactaattaaactttccgaagggtcaaggtagtcaagtcatacgaccaacagaacacactacccgaagacgactacgtcgaccctaagaacgtacgggaacgacgggaacggaaaccgtacggatacgttccggtaacggacccgtaacgtaccggttacctttaagttaagtttattagggttacgacggtaacggaacgttaaaccgttaaaactttcccgttaaacccttaaactaacgttttaaacgtaaccggtaacgttacggtaaggggtaaacgtttcggtaactttttaacgtttttccg

SEQ ID NO: 436455 - DNA, 647 bp, Homo sapiens
  misc_feature: GZ8MTXP02HO9YT.38.25.C03.1.454.CMB.2.raw
  modified_base (355)..(355): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacaagggcttgagtggatgggatggatcagcacttacaataggaaaactacaaaggttancgacaactataacttcgaaggacagtactactaatacatacgaaccaacgaacgaacaacctaacgtaccgaacgaacgacctaacgtacgacctaacgacgtacggaaacgtacggaaacggtaaccgtagaacgtactacgtacgaaaccgaaccgtaacggttactttaagttaagtttacgttagtacggtacgtaagtaaacgtaaacttaaaccgttacccttaacttaacgtaacgttaacgttaacgaacgttacggtaaggtaacgttacgtttaactttacg

SEQ ID NO: 436456 - DNA, 683 bp, Homo sapiens
  misc_feature: GZ8MTXP02IZWM1.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttggagtggatgggatggatcgagctacttacaagtacggaaaacacgaaaagtatcgacacaattaactttccaggggcagagtcatcatgaaccacagacacactccgaacgaacgcacctcgaccctaacagtcggtaaaaccgtaggaacggtaaacccgttaggaacgtacgtaccgtacggaaccgtaaccgtacccgggtaccctttaatttaaacgtttacgtttagggttacggaaccggtaaggtaaaccggtaaaaccttaaaacttttaccccgttaacccgtttaaaccgtaaatttaaccgtttaaaccggtaaaccggttaacgttaacggggtaaacggtttacggtttaacccgttttttaaacg

SEQ ID NO: 436457 - DNA, 638 bp, Homo sapiens
  misc_feature: GZ8MTXP02I5K4F.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgacggccccgtggaccgaagggcttggaggtggagtgggatggatcgagcaacttacaaagtaggaaaacacaaaagtatacgacaactaattaaatttccgaagggtcaggacgtacaatacgaatacgaaccaacaacgacaactaacaccaacgacgaccactacgacctaacgacgtacggaaactaggaaacggaaacctagaacgtacgtacgaacgaaccgaaccgtaacggtaccctttaaagttaactttaagttacgtacggacgaagaaacgtaaactaaactttccctaaccttaacaattaacgtaacgaacgtagtagtaagttacgttacttttaacg

SEQ ID NO: 436458 - DNA, 619 bp, Homo sapiens
  misc_feature: GZ8MTXP02HQOXV.38.25.C03.1.454.CMB.2.raw
  modified_base (371)..(371): a, c, t, g, unknown or other
  modified_base (419)..(419): a, c, t, g, unknown or other
  modified_base (428)..(428): a, c, t, g, unknown or other
  modified_base (437)..(437): a, c, t, g, unknown or other
  modified_base (452)..(452): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtcgtgggtgcgacgacggccccgtggacgaagggcttaggaggtggagtgggagtcgggatcaggctaacttaacgaagtaggaaacacgaaagtntacgacactattaactttcgaagggcagtagtacatcatacgaaccanacgacacanaccacgganaccacgtcaccctanacgtacgaaacgtacgaacgaaccgtagaacgtattaccgacgaacggtaccgacggttactttaaattacgttagttcggtagacggtaaaggtactaaaaccttaactttcctaaaccttactaagttaaccgtagaacgtagtaggtaatcgtttactttaacg

SEQ ID NO: 436459 - DNA, 650 bp, Homo sapiens
  misc_feature: GZ8MTXP02JZBIK.38.25.C03.1.454.CMB.2.raw
  modified_base (421)..(421): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagcgtgggtgcgacaggcccctggaccaagggtcttggagtggagtgggatggatcagctacttacaataggaaaactacaaaagttatcgacacaattaaactttccgaaggggctaggacgttaccattacaatcgaaacccacgaanaaccaacactcccaaacgacgacaacctcgaccctaacgagtacggaaacctagggaacgggtaaacctgaacgtacgtacgtaacggaaccgaaccgaccgggttacctttaagttactttaagttcggtacgacgaaaggtaactaaacctaaaactttcccgtaacccttaactaaagttaacgtaaccgtaaagtacgttaaggtaaggttactacctttttaag

SEQ ID NO: 436460 - DNA, 658 bp, Homo sapiens
  misc_feature: GZ8MTXP02IV27T.38.25.C03.1.454.CMB.2.raw
  modified_base (353)..(353): a, c, t, g, unknown or other
  modified_base (359)..(359): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacacggcccctggacgaagggcttgaggtggagtgggatggatcgagcacttacaagtaggaaaacanaaagtntagacactaattaactttccgagggcaggtacgtacaagttaccagtacgaaccaacaagaacacactaccgaacgagacacctagacccttaagacgttacggaaacttaggaaacggtaaaccctgacgtagttccgaacggaccggtaaccgtaacgggttacccttaagtttaatttagttacggtaggtacggtaaagtaacggtaaactaaaacgttttacccttaacctttaacctaaagtttaacgttaacgaaacgttacgtaggttaaacgttggttacttttttaacg

SEQ ID NO: 436461 - DNA, 636 bp, Homo sapiens
  misc_feature: GZ8MTXP02JF4BL.38.25.C03.1.454.CMB.2.raw
  modified_base (335)..(335): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtggtgcgacacggcccctggaacaagggcttggagtggagtggatggatcgagcactanaataggaaaacacgaaaagtatacgacaactaattaaactttccgaagggtcaggtagtacaatacaatacgaaaccaacaagaaccaacgactacccacgaacgactaacctcgacctacgaagtacggaaactaggaaacggtaaacctggaactacgtacgtagaaccggtaacgaaccggtactttaagttaattagttaggtacgacggtaaagaacgtaaactaaaactttccctaaccttaactaagttaacgttaaacggaacgtaacgtaggtaagttacgttacttttaag

SEQ ID NO: 436462 - DNA, 650 bp, Homo sapiens
  misc_feature: GZ8MTXP02G3SNN.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatgggtgtcgagtcgtgggtgcgacgacgggcccctggacgaacgggtctggaggtggagtgggagtggatcgagctaacttacgaagtacggaaaacaacgtaaagtatcgacaactaattaacgttccgaaggggtacaggtactacattacgaatccgaaccacgaacgaaccacctacaccgaacgaacgcaaccgcgacccttaagacgtacgtaaacgtcggaaacggtacctagacgactacgacgaacgaaccgtacggtacctttaataagttgttacggtagacgaaacggactaaacctaacgtttccctaacttaacctagttaaaccgttaaaccgacgtaagtaaggtagttacgttacgtttttaacg

SEQ ID NO: 436463 - DNA, 719 bp, Homo sapiens
  misc_feature: GZ8MTXP02JD0L1.38.25.C03.1.454.CMB.2.raw
  modified_base (371)..(371): a, c, t, g, unknown or other
  modified_base (475)..(475): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcgagtcgtgggtgcgacgacggccccgtggacgagggtcttggaggtggagtgggatggatcgagactaacttaacaagtaggaaacaacgaaagtanacgacaactaattaacgtttacgaggacaggtagtactatacaagttacgaaccaacgaacgaaccaactaaccgaccacgaacgaccacgtacgacccttaanacgtacggtaaactagggaaaccgtaaaccgtaggaacgtaacttccggaacggtaaaccgtacccgttaacgggttaaccctttaaagtttaactttagttaaccggttagggacgtaaaacgttaacggtaaaacctttaaaccgttttacccttaaacccgtttaataaaaccgtttaaacgtaaaccggtaaacggtaaagttaccgggtttaaaaggtttactttaacgttttttaacg

SEQ ID NO: 436464 - DNA, 575 bp, Homo sapiens
  misc_feature: GZ8MTXP02IE21A.38.25.C03.1.454.CMB.2.raw
  modified_base (374)..(374): a, c, t, g, unknown or other
  modified_base (379)..(379): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagcgtgggtgcgacaggcccctggacaagggcttggagtggatgggatggatcagcaattacaatggaaaacacaaaagtatagacaacataacgtttcggggntaagngtacatcaatacgaccacagaacacaatcccaacgagaccactacgacctaacgatacggaaacctggaacggaaacctggaagacttacgagaacgacgaaccggtacttaataattatggtagcgaagagaactaaacttcctaccttaataatacttaacgaacgtatacggtaaagtcgtacttttatttcg

SEQ ID NO: 436465 - DNA, 694 bp, Homo sapiens
  misc_feature: GZ8MTXP02HB5J0.38.25.C03.1.454.CMB.2.raw
  modified_base (371)..(371): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttatggtgtcagcgtggtgcgacgacggccccgtaggacgaggtcgttaggaggtggagtgggatggatcgagactacgttaacaagtacgaaactaacaaagttanacgtacaactaattaacgttaccgagggacagacgtacatacaagtacgaccaaacgacgaacaaccaactaccgaacgaacgacctaccgtacgacccttaacgacggttaacggaaacgtaggaaaccggtaactaggaactattacgtacgaaccggtacctaacgggttactttaattaacgtttagtacgttacggaacggtaagtaaacggtaaactttaaaacccgtttccctaaccctttaaagtaaacttaaccggtttaaacgaaccggttaaacggttaggtaaaacggtttcgttaacgtttttttaaccg

SEQ ID NO: 436466 - DNA, 777 bp, Homo sapiens
  misc_feature: GZ8MTXP02GBXV8.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacaagggcttgagtggagtggatggatcagctacttacaagtaggaaacacaaagtatacgacaactaattaaactttacccgaaggggtacagggtaacgtacaattacaacgtacgaacccaaacaacgaacctaaaccaactaccccgaaacggaacgaccaaccttcggaacccttaacaacgttacgggaaaacccgttagggaaacggtaaaccccgttaggaaccgtaagttacccgtaacgggaaacccgaacccgtaaccggggttaacccgtttaaacgtttaaacttttaaaggtttggttaccggtaaaccgggtaaaagggaaaccggttaaaacccgttaaaaaaccgtttttcccccgttaaacccgttttaaaccgtaaaacgtttaaaccgtttaaaacccggaaaacggttaaacggttaacgggggtaaaacgtttcggtttaaccccgtttttttaaaacg

SEQ ID NO: 436467 - DNA, 760 bp, Homo sapiens
  misc_feature: GZ8MTXP02IGXH1.38.25.C03.1.454.CMB.2.raw
  modified_base (286)..(286): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacnggcccctggacaagggcttggagtggagtgggatggatcaagcaactttacaaatcggaaaacacgaaaaagtctacgaccaaacgaattaaacgtttacccgaaggggtacctagggtaacgttaacaacgttaccaaacgttacggaaaccctaacgaaacgaaccaaaccgactacccgaaacgacgacaaccgttacgaccctaaacgtacgtaacgggtaaaccttaggaaaccggtaaacccgttggaaacgtacgttaccgtacggaacccggtaaaccgtacccgggtaaccctttaaagttaacgtttaagtttacgggttaccggaaaccggttaaggaaaaccttaaaccggttaaaaaccgttttccccgttaaacccttttaaaacgtacgtttaaaacgttaacggtaaaaccgttacggttaaacggggtaaaggttacctttaaacggttttttaacg

SEQ ID NO: 436468 - DNA, 610 bp, Homo sapiens
  misc_feature: GZ8MTXP02GV6CT.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagcgtgggtgcgacacggcccctggacgaagggctgagtggagtgggatggatcgagcacttaacgaagtaggaaaacacgaaagtatacgacaatataacttccgaggcagagtacactcaatcgaccagaacgacacactaccacgacgacactcgacctaacgagtacggaaacgtgaaacggaacctggatacgtacgtagaaaccgacgaccggtacctttaagttacgttagttggtacgacgtaaggtaaacaaactaaacctttcctaaccttaactaacgttaacgtaacggtacgtaagtacggtaaagtttcgttaactttttacg

SEQ ID NO: 436469 - DNA, 716 bp, Homo sapiens
  misc_feature: GZ8MTXP02GD5A5.38.25.C03.1.454.CMB.2.raw
  modified_base (398)..(398): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacacggcccctggacgagggctgagtggagtgggatggatcgagcacttacaagtaggaaaacacgaaaagtatcgacactaataaattccgaaggggcaggatcatcatcgaccanaagacaacaactccaacgagaccactacgaccctaacgacgtacgggtaaaacctaggaaacggggaaacccttaggaacgtaaacgttccgtacgggaaacccggaaccgtaacccggggttaaccctttaaagtttaacgttttaaaacgttgggttacggaaacccgggtaaggtaaaacggtaaacccttaaaaaacgttttcccccgttaacccgttttaaaactaaccttttaaaacgtttaaaccccggaaaacggtttaacggttaaaacgggggtaaacgtttacgtttaacccggttttttttaaacg

SEQ ID NO: 436470 - DNA, 622 bp, Homo sapiens
  misc_feature: GZ8MTXP02ILZQW.38.25.C03.1.454.CMB.2.raw
  modified_base (405)..(405): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtaccaacaataagaattactcgcttaggaccagcacgaaaccaggacagcctacctaagttcgctactactttacgtgggactacgtccgtaccccggggacggtccccggggtcccctaggacccgtacttccgaggtccggacgaggccgggtctgganacagtactttcactctacaccatcagcagcctgcgaggctagaagtgtggtcggtacttagttttacttacgtcgtacgagtactaagttagttaagtagttacgttaccgtacgtaacggttaccggtttcgggggacccgggggtaaaccaacggtccgtaggtaacgtaacgtaaccgaaaacgtaacggtcggtacggcgtacgacctaaccg

SEQ ID NO: 436471 - DNA, 679 bp, Homo sapiens
  misc_feature: GZ8MTXP02JFZQT.38.25.C03.1.454.CMB.2.raw
  modified_base (405)..(405): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagcagttatggtgtcagcgtgggtgcgacacggcccctggaccaagggcttgaggtggagtgggatggatcgagcacgttacaagtacggaaacaactaaagtatgacactaataattccgagggcaggatacaagtcaatcgaccanaacgacaacactaccaacgagacctacgtcgtacccttaaacgagtacggtaaacgtacggaacggtaacgtaggaacgtacgtacggtaacgaaccgtaaccgtaaccggttaacctttaaagttaacgtttacgttacggtacggtaaacggtaacgtaaaaccgtaaaacttaaacccgtttaccccgttaaacccttaaacgttaaacgttaaacgttaaaccggtaacgttaaacggttaaggtaaacgtttacgtttacgttttaacg

SEQ ID NO: 436472 - DNA, 555 bp, Homo sapiens
  misc_feature: GZ8MTXP02FMO9V.38.25.C03.1.454.CMB.2.raw
  modified_base (448)..(448): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggccccctggacaagggcttgagtggagtggggatggatcagcacgttacaatggaaaacacaaaagtatagacacaataatttccagggcagagtcatcatagaccacagacacactccgacgagcactgacctacatgaaactgaaggaacctgagactcncgacgacacggccttatattagttgtagcgtaagacgtaactaaacttccctaccttaaccaattaacgttaacgaacgtaatagggaaacgttgtactttttaacg

SEQ ID NO: 436473 - DNA, 685 bp, Homo sapiens
  misc_feature: GZ8MTXP02JMGYQ.38.25.C03.1.454.CMB.2.raw
  modified_base (356)..(356): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtggtgcgacacggcccctggacgaagggcttgagtggagtgggatggatcgagcacttacaagtaggaaacacaaagtntacgacacgtaattaaacgtttccgagggtacagacgttacagtacaagtacgaaccaacaacgactaacactaccaacgaacgtacaaccgtcgaccctaacgacgtacggaaactggtaaacggaacccttaggaaacgtacgtacgtaccggaaccgaaccgtaaccggggtaaccctttaagttaacgttttaaagttcggttacggtaccggaaaggtaacggtaaaccttaaaaactttccccgtaaccctttaacctaaagtttaacgtttaaaccggaaacggtaacgtaagggtaacgtttacggttacctttttaaacg

SEQ ID NO: 436474 - DNA, 672 bp, Homo sapiens
  misc_feature: GZ8MTXP02JUPHT.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacgaagggcttgagtggagtgggatggatcgagctacttacaagtaggaaaacacgaaaagtatacggacaactaattaaacgtttccgaaggggaccaggtaacgttacaacgttaccaagtacggaaacccaacaacgaaccaacaactacccgaacgaacgacctacctcgacccttaacgacgttacggaaaaccgtggaaaccgggtaaaccttaggaacgtacgtaccgtacgaacccggtaacgtaccggtacctttagttaacttagttaggtacgacgtaagtaacgaaacttaaacctttcctaaccgttaactaaagttaacgttaaccgaacgtacgtaggtaaacgttcgtactttttaacg

SEQ ID NO: 436475 - DNA, 713 bp, Homo sapiens
  misc_feature: GZ8MTXP02I7X5W.38.25.C03.1.454.CMB.2.raw
  modified_base (439)..(439): a, c, t, g, unknown or other
  modified_base (449)..(449): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggcctcgagtgaacgtctcctgcaaggcttctggttacacttttagctagttatggtgtcagcgtgggtgcgacgacggcccctggaccgaggctaggagtggagtgggagtggatcagctactacaagtacggaaacaacaaagtactacgacaacgtattaacgtttccgaaggggcaggacgttacaacttacgactacgaaaccacaaacgactaacccaaccnaccgacgacnaacctacgaccgtaccgaacgtacgggaaaccgtacggacgggaaccgtacgaacgtacgtaccgtacggaaccggtaaccgtaaccggtaacccgtttaacgtttaacgtttaacgtttacggttacggtaccggtaaacggtaaacggtaaaccgttaaaaccgtttacccgtttaacccgtttaaaccgttaaaccgttaaacgtttaaaccggtaaacggttaaacggtttacggggttaaacggtttacggtttaaccg

SEQ ID NO: 436476 - DNA, 667 bp, Homo sapiens
  misc_feature: GZ8MTXP02J5OF5.38.25.C03.1.454.CMB.2.raw
  modified_base (359)..(359): a, c, t, g, unknown or other
  modified_base (379)..(379): a, c, t, g, unknown or other
tcagtcgatcacgtcacgaccggtgctcgatttagtagtgtagatttgggtttggggacccaaaaacccacacccctccttggggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctgggttacacttttagcagttatggtgtcagctgggtggcgacgacggccccgtcggacgaagggcgttggagttggagtgggtagtacggagtcaagcacttacagtacgaanaacaaacgtactacgacacncaaactttctaaacggtttccgcgggaacgttaaacggagttccaacttctagtaccaacccgaaccgaaaacccgaccgaaaccaacccgggttaaccaccggaaccgttaccgacccgttaaccgaccgttaccgtaacgtaaacggtaaccgggaacgtacggaacgtagtacgtacgtacgtacgacggtaaccgtacgttactacttaatttcgtgtagaacgtacgtacaacgtacctacttactaactaacttacttacggtactacgtaacgtacgtacg

SEQ ID NO: 436477 - DNA, 641 bp, Homo sapiens
  misc_feature: GZ8MTXP02FOUFX.38.25.C03.1.454.CMB.2.raw
  modified_base (413)..(413): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacaggcccctggacaagggcttgagtggagtgggatggatcgagctacttacaagtggaaaacacgaaaagtatagacaactaataactttccgaagggtcagacgtacaagtacatacgaacccaaanaacgaacacacgtaccaacgacgacacctacgaccctaagaacgtacggaaacgtacggaaacggtaaaccgtagaagtacgtacgacgaaccgaacgtaccgttaactttaagtaagtttagttagtacggacgaaagtaaacgtaaacttaaacctttaccctaccttaactaacttaaacgttaacggaacgtaaggttacggtaacgttacgtttacgtttaag

SEQ ID NO: 436478 - DNA, 723 bp, Homo sapiens
  misc_feature: GZ8MTXP02H1NST.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagtcgtgggtcgcgacgacggcccccgtaggacgaagggtctggaggtggagtgggatggatcgagctacttacgaagtaggaaaacacgaaagtatacgacaactataactttcgagggacagacgtcatacatacgaaccaacgacgaaccaacactacccgaagacgaccaactccgaaccctaacgacgttacgggaaacgttacggaacggtaaacccttggaaagtacgttaccgtaacggaaacccgtaaaccggttaacccgggttacctttaaagtttaaccgttttaagttacggtacggttaaaccggaaaggtaaaccgtaaaacctttaaacccttttaccccgtaacccgttttaaactaacgtttaaaccgtttaaaccggaaaccgttaaggttacgggtaaaaccgtttacggtttaaccccttttttaaacg

SEQ ID NO: 436479 - DNA, 654 bp, Homo sapiens
  misc_feature: GZ8MTXP02IZ8R4.38.25.C03.1.454.CMB.2.raw
  modified_base (435)..(435): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttctggttactacttttagcagttatggtgtcagcgtgggtgcgacgacggcccctggacaagggcttggagtggagtgggatggatcgagcaacttaacaagtaggaaaacacgtaaaaggtatacgactaactaattaaacgtttccgaaggggtcaggggtactacaaattacaacgtacgaaacccaanaacgaacaaacactacccgaacgacgacaccgtacgacctaacgactaggaaacctaggaaacggaaccgtgaacgacttacgacggaacgaaccgacggtaccttaagttattagttaggtacgacggaagtaacgtaaacctaaacgtttccctaactttaactaagttaacgttaaaccggaacgtacgtaggtaacgttaggttaccttttaacg

SEQ ID NO: 436480 - DNA, 741 bp, Homo sapiens
  misc_feature: GZ8MTXP02FZD5G.38.25.C03.1.454.CMB.2.raw
  modified_base (359)..(359): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagcgtgggtgcgacacggcccctggacaagggcttggagtggagtgggatggatcgagctacttaacaagtaggaaaacacaaaagtanacgacaactaataaactttaccgaaggggacaggtacgtacaatacgaattacggaaccaacaagactaacactaccacgagaccacttcgacccttaacaagtacggaaactacggaaacggtaaacccgttaggaacgtaacgttacgtaaccgggaaaccggaaaccgtaacccgggttaccttttaaaacggttaacttttaaacgtttcggttaaggacccgggtaaaaggtaaaccgggttaaaacccttaaaacgtttttaccccctttaaacccgtttaaaaccgttaaacttaaaacgtttaaacccgggtaaaaccggtaaaacggtttacggggttaaaaacgggtttcgtttaacgttttttttaaaccg

SEQ ID NO: 436481 - DNA, 625 bp, Homo sapiens
  misc_feature: GZ8MTXP02IB8QG.38.25.C03.1.454.CMB.2.raw
  modified_base (449)..(449): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctggtgcgacgacggcccctggaccaagggcttggagtggagtgggatggatcgagctacttacaataggaaaacacaaagtatgacaactattaaactttccaaggggactaggacgttacaacgttcaatcgaaccaacaacgaacaacactacccaacgaacgaccacgtanaccctaacagtacggaaactcggaaggaacccgttagagtacgttccaggaaccgaacgtaccggtacctttaattagtttacgttgtagacgaaagaacggtaaactaaactttacctaccgtttaactaacttaacgttaacggacgtaacgtaaggtacgtagtacttttaag

SEQ ID NO: 436482 - DNA, 573 bp, Homo sapiens
  misc_feature: GZ8MTXP02FF0WI.38.25.C03.1.454.CMB.2.raw
  modified_base (385)..(385): a, c, t, g, unknown or other
  modified_base (417)..(417): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctggggtgcgacaggcccctggacaaggggcttgagtggatgggatggatcagcactacaatggaaacacaaagtatgcacataatttccagggcagagtcatcatgaccanagacacataccagaacgcaactgacccctaanagtacggaaacgtggaacgtaccgagaacgtacgtacgtacgacgaacgaccgtacttaagttattagtgtacgacgaagaacgtaaacctaaacttacccttaacctaactaaagtaacgtaacgaacgtaacgtaggtaaactcgtactttaac

SEQ ID NO: 436483 - DNA, 590 bp, Homo sapiens
  misc_feature: GZ8MTXP02G2R6T.38.25.C03.1.454.CMB.2.raw
  modified_base (386)..(386): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaacacaaagtatcgacacataatttccagggcagagtcatcatgaccanagacacactccaagagacactcgaccctaacatcgggaaacttggaacggtaaccctggacgagtcgtagaaccgaacgaccgggtacctttaagtatttagtttggtacgtaccggaagaacgtaaacctaaaactttcccttaccttaactaataacgtttaaacggaacgtagttaggtaacgttacggtactttttaacg

SEQ ID NO: 436484 - DNA, 671 bp, Homo sapiens
  misc_feature: GZ8MTXP02JQYTP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacagggcttggagtggagtgggatggatcagctacgttacaagtaggaaaacacgaaagttatacggactaactaagttaaacgtttccgaaggggctaggagtacaacttccaagtacgaaaccacgaacgaccaactactacccgaacgtacgacctacctcggtaccctaacgtacgtacggtaaaccgtggtaaacggtaacccgttaggaacgtacgtaccgtacgaaccgaacgtaccggtacctttaagttaagtttacgtacggttacgacggtaagtaacggtaaaccttaaacgttacccgttaaccttaactaacttaaacgtacgtaacggtagttacggtaaacgttcgttactttttaacg

SEQ ID NO: 436485 - DNA, 649 bp, Homo sapiens
  misc_feature: GZ8MTXP02G1XCF.38.25.C03.1.454.CMB.2.raw
  modified_base (218)..(218): a, c, t, g, unknown or other
  modified_base (382)..(382): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctnagtgaacgtctcctgcaaggtcttcgtggttactacttttagctagttatggtgtcagtcgtgggtgcgacgcggcccctggaaccgaagggtctggaggtggagtggggatggatcgagtacgtaacgttaacgaagtacggaaaactaacgtaaaaggttanacgaactaaactaacgttaaacgttacggaagggtacaggtacgtactaactacgaagtacgaaaccaacgaacgacaaccactacccgaagacacacgtacgacctaacgtacgtaacggaaacgtaggaaaccgtacgtagtaacgtacgtacgacgaaccgacgtacgttacttaattagttagtgtacgacgaagtacgtaaacttaccttacctaacttactaagtaacgtacgaacgtacgtagtactacgtttactttcg

SEQ ID NO: 436486 - DNA, 581 bp, Homo sapiens
  misc_feature: GZ8MTXP02GSLO1.38.25.C03.1.454.CMB.2.raw
  modified_base (394)..(394): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtgagtgggatggatcagcacttacaataggaaaacacaaagtatagacacaataacttccgagggtcagagtacagtcatacgaccanacgaacacataccaacgacgacactcgacctacaatcggaaactacggaaggtaaccctagagtaactcgtagaccgaacaaccggtaccttaagtaatttacgtgtacgaccgtaagaacgaactaaaacttcctaaccttacaattaacgtacgtaaccgtaagtaggtaacgtagtactttaag

SEQ ID NO: 436487 - DNA, 641 bp, Homo sapiens
  misc_feature: GZ8MTXP02F7N2E.38.25.C03.1.454.CMB.2.raw
  modified_base (455)..(455): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggccccgtggacgaagggcttggaggtggagtgggatggatcgagctaacttacaagtaggaaaacacgaaaagtatacgacaactaattaaacgtttccgaaggggcagtacgtacaattcatacgaaaccaacaagacacatacccagaacgcactgaccctanagtacggaaacgtcgaaacggaaccgtagaagtacttacgtaacggaaccgaacgtacggtacctttaagtaagtttagttggtacggaaccggtaaagtaaacgtaaaccttaaactttcccttaaccttaactaacttaacgtttaacgaacgtaagtaggttaagttacgttactttttaacg

SEQ ID NO: 436488 - DNA, 613 bp, Homo sapiens
  misc_feature: GZ8MTXP02F3ES2.38.25.C03.1.454.CMB.2.raw
  modified_base (431)..(431): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggcctggggcctcagtgaacgtctcctgcaaggcttctggttactacttttagctagttatggtgtcagcgtgggtgcgacacgggcccctggaacgaagggtcttggaggtggagtgggatggatcgagctaacttaacaagtacggaaaacaacaaaagtatacgacaactaaattaaacgtttccgaaaggggcagggactactaatacaatacgaaccaanaacgactaacactaccaacgagacactcgacctaacagtagaaacgtagaaacggaactagagtactacgtaacgacgtaacgaccggtacttataattagtgtagacgaaagtacaaactaaacttcctaactaactaattaacgtacgaactaacgtaggtaaacgtttcttactttacg

SEQ ID NO: 436489 - DNA, 697 bp, Homo sapiens
  misc_feature: GZ8MTXP02ILY01.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgaggccccgtggacgaagggcttgaggtggagtgggatggatcgaggctaacgttacaagtacggaaacacgaaaagtatacgaccaactaattaaacttttcccgaagggtacaggtagtacaattccaatcgaaaccaacaagacaaccactacccgacgaacgacaccttacgacccttaacgagtacggaaaacgttacggaaacggtaaaccccgttagaacgttacgtaccgttaccggaaccgtaaccgtaaccgggtaccttttaagtttaaatttagtttcgtacggtacggaaagtaaacggtaaacttaaaacgtttccctttaaacccttaactaaagtttaaaccgttaacggtaccgttaagttaacggtaacggtttacggtacttttttaacgg

SEQ ID NO: 436490 - DNA, 736 bp, Homo sapiens
  misc_feature: GZ8MTXP02I4RSD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacaggcccctaggacaagggctgagtggagtgggatggatcagcacttacaataggaaacaacgaaagtatacgacaactaattaaactttccgaacggggtacaggtacgtacgaataccaagtacgaacccaacgaaacgaacaaccgaactacccgaacgaaccgtacacccgttacgaccctaacgagtacgggaaacttacggaaacggtaaacccgtaggaacgtacgttaccgacggaaccggtaaccgtacccgggtaaccctttaagtttaaacgtttagtttacgggtacggtacggtaaacggtaacggttaaaaccttaaaaccgttttaccccgttaacccgtttaaaccttaaacgtttaaaaccggttaaaccgggttaaccggttaaagggtttaccggggtaaaacggtttcggtttaaaccgtttttttaaccg

SEQ ID NO: 436491 - DNA, 704 bp, Homo sapiens
  misc_feature: GZ8MTXP02GA8P5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttacactttttagctagttatggtgtcagctggggtgcgacgacggccccctggaccgaagggcttggaggtggagtgggatggatcgagcacgttacaagtaggaaaacacaaaagtatacgacaactattaaactttccgaaggggacaggtacgtaccaattaccgaattacggaaacccaacgaaacgaaaccaacaaacctacccaaacggaacgtaccaccgttacgacccccttaaagacgttacgggaaaaccgttggaaaaccggggtaaacccttaggggaactaacgttacgtacggaaccgaccgtaaccggggtacctttaaagttactttagtttacgaggtaccggaagaaacggtaaactaaacgtttaccccttaaccgttaactaattaaacgtttacccggaacgtaacgtaggtaaacgttgtaccgttttttaacg

SEQ ID NO: 436492 - DNA, 655 bp, Homo sapiens
  misc_feature: GZ8MTXP02HWLPR.38.25.C03.1.454.CMB.2.raw
  modified_base (617)..(617): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggacgtggggcctcagtgaacgtctcctgcaaggtcttctggttactacttttagctagttagtggtgtcaggtcgtgggtcgcggacgacgggcccccgtggaccgaagggtcttggaggtggagtggggatggatcgagactaacttacgaagtaggaaaacaacgaaaagtatcgactaactaattaaacgtttccgaaggggtcaggtacgtactaagtcctaagtcgaaaccaacgacgaacacactcccgaacgacgactaccgtcgaccctaacgagtacgggaaacttcgggaaaacggtaaccgttaggaacgtacgttaccgacggaaaccgaccgtaccggtactttaagtactttaagtcgtaggacgtaagaacgtaaacttaaacttccctaacttanattaacgtacgactagtagtacgttctttacgtttacg

SEQ ID NO: 436493 - DNA, 680 bp, Homo sapiens
  misc_feature: GZ8MTXP02H5W9W.38.25.C03.1.454.CMB.2.raw
  modified_base (387)..(387): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttagtggtgtcagtcgtgggtgcgacgacggcccctaggacgaagggtcttggaggtggagtgggacgtaggactcgagtcctaacttaaacgaagtaacggaaaccaaacgaaaaggttanacgacaactaattaacgttacgagggtacaggtaactacagttacacgtacgaaaccacaacgacaacctacgacccgaaacgacgacctaacgtcgtaaccctaacgtacgtacggtaaaacgttcggaaaccggtaaccgttagaacgtacgtacgacgtaaccgaacgtaccgtaactttagttattagttacgacgacgtaaggtaactaaacgttaaacctttcctaaaccttactaaacgtaaccgtttaacgaacgtagtaacggtaagtttcgtttacttttacg

SEQ ID NO: 436494 - DNA, 640 bp, Homo sapiens
  misc_feature: GZ8MTXP02JDC2E.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcgagtcgtgggtgcggacgacggccccgtggacgaaggggtcttggaggtggagtggggatggatcgagctaacgttaacaagtacggaaacaacaaagtatacgacaactaattaaacgtttaccgaaggggacaggtagtactaactccaagtacgaaccaacaagaaccaacactacccgaagacgaccactcgacctacagtacgggaaactaggaaacggaaccttagaactagtacgacgaaccgacgtacggtaccttaaatatttagtggtacgaggaaagacgtaaactaactttaccctacttaactaaattaacgttaacgaacgtagttacggtaacgttcgttactttttaacg

SEQ ID NO: 436495 - DNA, 578 bp, Homo sapiens
  misc_feature: GZ8MTXP02GK6LR.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagctggtgcgacaggcccctggacaagggtctgagtggagtgggatggatcgagcacttaacaataggaaacaacaaaagtatcgacacaagttaaacgtttccggggacaaggagtaccaagtccaatcgaaaccaacagaaccacactacccaacgacgcaactcgacctacatacggaactaggaacgaactagaagtatacctagaaccgacgacggtaccttaatattatgagcgagacgaactaaactccttactaactacttagtaaccgagtaagtaggtaagtctactttacgtttc

SEQ ID NO: 436496 - DNA, 602 bp, Homo sapiens
  misc_feature: GZ8MTXP02IAKN9.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctggttactacttttagcagttatggtgtcagcgtgggtgcgacaggcccctggacgaagggcttgagtggagtgggatggatcagcacttacaataggaaacacaaagtatgacactataactttccgaggcagagtcagtcatacgaccacagacacactccacgagacactcgacctaacacgtaggtaaactggaaaccggaaacctggaacgtataccgtacggaaccggacgtaaccgggtacctttaagtaatttacgttgtacggtaccgaaaggacgtaaacctaaaactttccctaacctttaacaacttaacgttaaacgacgtaagtaggtaacgttgttaccttttacg

SEQ ID NO: 436497 - DNA, 546 bp, Homo sapiens
  misc_feature: GZ8MTXP02HL439.38.25.C03.1.454.CMB.2.raw
  modified_base (405)..(405): a, c, t, g, unknown or other
  modified_base (431)..(431): a, c, t, g, unknown or other
  modified_base (443)..(443): a, c, t, g, unknown or other
  modified_base (466)..(466): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgctcactcccaggttcaattggtgcagtctggagctgcggtgaagaggcctggggcctcagtgaacgtctcctgcaaggcttctggttactacttttagctagttatggtgtcagctgggtgcgacacggcccctggacaaggggcttggagtgggagtgggagtggatcgagacacttacaaagtaggaaaacacgaaagtatagacaactaattaactttaccgagggcaagagtaccatacanacgaccacagaacacactccgagacncactcgacctanacgaggaactagacggaactganatcagacgacacgacttatattatgcgtagacgagaacacttcctacttacaatactacgtacagtacgtacgtatttac

SEQ ID NO: 436498 - DNA, 508 bp, Homo sapiens
  misc_feature: GZ8MTXP02I41EA.38.25.C03.1.454.CMB.2.raw
  modified_base (364)..(364): a, c, t, g, unknown or other
  modified_base (380)..(380): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacagggctgagtggatgggatggatcagcacttacaatggaaacacaaagtatgcacataattccagggcngagtcatcatgaccanagacacatccacgagcactgcctacatggaactgaggacctgagatacctagacgacacggacttagtatagttgtgacgagagacaaacttcctactacataagtacgacgatggaatgtactttag

SEQ ID NO: 436499 - DNA, 581 bp, Homo sapiens
  misc_feature: GZ8MTXP02FHIL8.38.25.C03.1.454.CMB.2.raw
  modified_base (353)..(353): a, c, t, g, unknown or other
  modified_base (377)..(377): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttggagtggatgggatggatcagcacttacaagtaggaaacacaaagtancgacacataacttccgagggcagngtcatcatgaccacacgacaacactccaacgagcacctgaccctacagtcggaaacctggaaacggaaccctaggacgtaattccgagaaccgacgaaccggtccttaattaactttaagttggtacgacgaagacgaaactaaacttccctaccttaactaactaacgttaacgaaccgtatagggaaatcgtacttttaacg

SEQ ID NO: 436500 - DNA, 701 bp, Homo sapiens
  misc_feature: GZ8MTXP02IH32J.38.25.C03.1.454.CMB.2.raw
  modified_base (357)..(357): a, c, t, g, unknown or other
  modified_base (642)..(642): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacaagggcttgagtggagtgggatggatcgagcacttaacaagtaggaaaacacaaaagtntacgacactaattaactttaccgagggcagggacgttacaagttacagtacggaaacccaaacgaacgaacaacctaactcccgaaacggacgacctaccttacggaccccttaaacgagtacgggaaaaccgttagggaaacggtaaaccccgttagggaacgtacgttaccgtacgggaaaccggtaaccgtaaccggggttaccctttaaattaacgtttaagttcgggtacgacggtaaaggaaacgtaaaacccgtaaaactttccctaaaccctttaanaaacttaaacgtttaaccgaacgttagttaacggtaaacgtttcggttactttttaacg

SEQ ID NO: 436501 - DNA, 677 bp, Homo sapiens
  misc_feature: GZ8MTXP02IRAYO.38.25.C03.1.454.CMB.2.raw
  modified_base (350)..(350): a, c, t, g, unknown or other
  modified_base (358)..(358): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttgagtggagtgggatggatcagctaacttacgaatagggaaaacanaaaagtancgacaaccgtattaaactttcgaagggtcagagtacataccaatcgaaacctagaacgaaccaacaactcccgaacgacgactaacgtcgtaccctaacacgtaacggaaacttacggaacggaaacccgttaggaacgtactaccgtaggacccgaacgtaccggtaaccctttaagttaagtttacgttaggttacggacggtaaacgggtaactaaaaccgttaaactttaccccttaacctttaaaccttaagttaaacgtttacggaaaccgtacgtaaaggggttaacgtttacggtttaaacttttttaacg

SEQ ID NO: 436502 - DNA, 638 bp, Homo sapiens
  misc_feature: GZ8MTXP02FVJW6.38.25.C03.1.454.CMB.2.raw
  modified_base (455)..(455): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggaacaagggtcttgagtggagtggggatgggatcgaggctaacttacaaagtggaaaacacgaaaagtatccgacacaattaactttcccgagggcaggatcgaattccgaatacgaaccaacaacgaactaacgactaccgacgagccactcgaccctanacgtacggaaactacgaacggtaaccctgaagtacgttaccgtacgaaccggaaccgtaccggttaaccttataatttacgtggttacgacggtaagaacgtaaacctaaaactttccctaacctttactaaagttaaccgttaacggacgtaagtacggtaaaagtcgttactttttaaccg

SEQ ID NO: 436503 - DNA, 654 bp, Homo sapiens
  misc_feature: GZ8MTXP02HBZRM.38.25.C03.1.454.CMB.2.raw
  modified_base (347)..(347): a, c, t, g, unknown or other
  modified_base (369)..(369): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcgaaggtcttcgtggttactacttttagctagttatggtgtcagcgtgggtgcgacgacggcccctggacgaagggtcttgaggtggagtgggatggatcgagctaacttanaagtaggaaaacacgtaaagtntcgacaactaattaacttccgaagggtcaggtacgtacacttacactacgaaccaagaacgacacaactcccgaaagcgaactccgacgtaccctaagacgtacggtaacctaggaaacggtaacccaggaacgtactacgtacgaacgaacgttacggtacctttaagtacgtttaagttcggacgacggtaaagtaaacgtaaacgttaaacctttacccgttaaccttaataacgtttaaagtaccgtaacgtaacgttaggtaattcgttactttttaacg

SEQ ID NO: 436504 - DNA, 539 bp, Homo sapiens
  misc_feature: GZ8MTXP02F8P6O.38.25.C03.1.454.CMB.2.raw
  modified_base (506)..(506): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacttacaagtaggaaacacaaagtatcgacacataatttcgagggcagagtcatcatgaccacagacacactaccaacgagacactcgaccctaacagtagaaactggaacggaacctagagattcagacgacgacggtacttatattagttgtcgacgagacgaacaacttcctactanataatacgagtagtacgtaagtcgtactttacg

SEQ ID NO: 436505 - DNA, 741 bp, Homo sapiens
  misc_feature: GZ8MTXP02G31LX.38.25.C03.1.454.CMB.2.raw
  modified_base (375)..(375): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttagtggtgtcaggcgtgggtgcgacgacggcccctaggacgaagggtcttggaggtggagtgggatggatcgagctaacttacgaagtacggaaaactaacaaagttanacgactaacgtaattaacttacgagggtacagggtactacaacttacaagttaccgaaaccgaacaaacgaacctaccgtaaacacccgaaacgggaaccgactaacccgtaccggtaaacccgtaaacttaaacggaacggttaaaacgtcggtaaaacggtaaaccccgaggtaaacgtacggttaccgtaaacggaacccgaaaccggttaaccggttaaacctttaaggtttaattttaaacggtcgtaacggtaaacggaagtaaacggtaaaccttaaactttaccccgtaaacctttaacgtaacttttaaaccgaagtaacccgtagtaaacggttaagtaccggtttatttttaacg

SEQ ID NO: 436506 - DNA, 609 bp, Homo sapiens
  misc_feature: GZ8MTXP02JHJR5.38.25.C03.1.454.CMB.2.raw
  modified_base (568)..(568): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacgaagggcttgagtggagtgggatggatcgagctacttacaagtaggaaaacacgaaaagtatacgacaactaataactttccgaagggtacaggacgtacatacatacgaaccacgaacgacaacactaccgaacgacgacacctcgaccctacgacgtaggaaactggaaaggtaacctagaatagtacgtaggaccgacgaaccggtccttaattatttaagtcgttagaccggaagtaacgtaaactaaaacttccttaaccttaanattaacgttacgaacgtacgtaggaagttcgtacttttacg

SEQ ID NO: 436507 - DNA, 699 bp, Homo sapiens
  misc_feature: GZ8MTXP02F6FL0.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacacggcccctggacgaaggcttgagtggagtgggatggatcagcacttacaagtaggaaaacacaaaagtatacgaccaactaataactttaccgaaggggcaggacgtacaatacatacgaaccacaagacaacaactccgaacgagaccacgtacgacccttaacgaagtacggtaaaaccgtggaaacggggtaaacccttaggaacgtaacgttacgaacggaaaccggtaaacgtaacccgggttaacctttaaagtttaacgtttaacgtttaggttacggtaaccggaaaggtaaacggtaaaaccgttaaaaccgttttccccgttaaaccgtttaaacttaacgttaaaaccgtttaacggaaccgttaagttacggggtaaaattcggttaacttttttaaccg

SEQ ID NO: 436508 - DNA, 728 bp, Homo sapiens
  misc_feature: GZ8MTXP02IWCVN.38.25.C03.1.454.CMB.2.raw
  modified_base (285)..(285): a, c, t, g, unknown or other
  modified_base (306)..(306): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacnggcccctggacaagggcttgngtggatgggatggatcagcacttacaataggaaacacaaagtatacgacaacgtattaaacgtttccgaaggggcaggtacgtcgaattccaatggaacccaacgtaaacgaccaacaactaccgaaccgaacggtaccaaaccgttcggacccttaaacaaacgttacggggaaaacccgtttaggaaacggggtaaacccccttggaaacggtaacttaccgttaaaccggaaacgaacccgtaaaccggggttacccttttaagttaagtttaaacgtttggttaacggaccggtaaaggtaacggtaaaaccttaaaacgttttccccttaaccgtttaaaccgtaaattaacggttttaaacccgaaaccggttaacgttacgggggtaaaactttcgggtacctttttttaaacgg

SEQ ID NO: 436509 - DNA, 705 bp, Homo sapiens
  misc_feature: GZ8MTXP02ITC1A.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagctgggtgcgacaggcccctggacaagggctgagtggagtgggatggatcagctaacttacaagtacggaaacacaaaagtatacgactaacaattaaacgtttcccgaaggggtaccaggtacgttacaacgttacaacgtacggaaacccaaacgaacgaaccaaacctaactacccgaacggaacgaccaaccttacggacccttaaacacgttacgggaaacttacgggaaacggtaaacccgtagaacggtactaccgtacggaaccgaaccgtaccggtaacctttaagtttaacgtttagttacggttacggacggtaaaggaacgttaaaacctaaaactttcccttaaacccttaacttaaacttaacgtttaaaccggaacggttaaacgttagggtaaaacgtttcggttaactttttaacg

SEQ ID NO: 436510 - DNA, 679 bp, Homo sapiens
  misc_feature: GZ8MTXP02JYR8W.38.25.C03.1.454.CMB.2.raw
  modified_base (344)..(344): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacctaaggggtcttggaggtggagtgggatcggatcgagctaacgttanaagtaggaaaacaacaaagtatcgacacaattaacgttccgaaggggcaggacgtcagtacatcgaaccaacgacgaacaaccactacccgaacgacgtaccaacctcgaccttaacgagtacgaaaccgtggaaacggaaccctaggaacgagttacgacggaacggtaaccgtaccggtaccctttaagtttaaccgttagttacggtacggtaaccggtaaggtaaacgtaaaccgtaaacctttacccgtaaccttaaccgttaattaaacgtttaacccggaaacgttaacgttacggggtaaaactttcggttaacccgttttttaacg

SEQ ID NO: 436511 - DNA, 604 bp, Homo sapiens
  misc_feature: GZ8MTXP02IYK0H.38.25.C03.1.454.CMB.2.raw
  modified_base (472)..(472): a, c, t, g, unknown or other
  modified_base (494)..(494): a, c, t, g, unknown or other
  modified_base (531)..(531): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaaggaggccgtggggcctcagtgaacgtctcctgcaaggcttctggttactacttttagctagttatggtgtcgagcgtgggtgcgacgacggcccctggaacgaagggtcttaggaggtggagtggggatggatcagactaactttacgaaagtacggaaaacacgtaaaagtatacgacacaaattaacgtttccgaagggacaggtagtacatcaatacgaaccacaagaccaaacacaaccgaacgacgacacctacgaccctaanacgtagacctaggacgactganacgtcgacgacgacgcgtacttagtattagtggtacncggtaagacgtaaactaaacttcctaacttacaattaacgttaacggatagaggtacttagtttacttttacg

SEQ ID NO: 436512 - DNA, 687 bp, Homo sapiens
  misc_feature: GZ8MTXP02FJNXS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccacctcccaggttcaattggtgcagtctggagctgcggtgaaggaggccgtggggcctcgagtgaacgtctcctgacaaggcttctggttactacttttagctagttatggtgtcagcgtgggtgcgacgacggccccgtggaacgaagggtcttaggaggtggagtgggagtgggtatcgagtacctaacgttaacgaagttacggaaaaacaacgtaaaagtatacgacaactaattaaactttaccgagggaccaggtacgtacgaacttacaacgtacgaaaccctaacgaaacgaaccaacgaacaacccgacggaacgaccaaccgtcgtacctaacagtacgaaacgtacgaaacggtaaccgtggaatagtactacgaaccggacgtaccggttaactttaagttatttagtaggttacggacggtaaaggtaactaaacttaaaccgtttcccttaaaccttaaccgttaaattaaaccgttacgaacgtacgtaggtaagttcgttatttttacg

SEQ ID NO: 436513 - DNA, 790 bp, Homo sapiens
  misc_feature: GZ8MTXP02GVYYT.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagctgggtgcgacaggccccctggaccaaggtcggtcgtaggtggaggtagggtaggtaggtagtacgtagacggacctttaacgtaaacgtaaggtaaaacgaaactaaacgtaaagtacgtacgaacctaacgtaaactttaaccgttacggacggtacgtaacggtacgtactactacgtacgtaaccggaaaccaaacgacgaaaccaactacgaaccgacggacacccgtacgtaccaaccttaacgacggtaaacggttacgaagggtaaacccgtaaccggtaagtaacgggttacttaccggtaaaccggtaaaccgaaacccggttaacccgggtttaactttaaacggtttaactttaacgggtttaggacccgggttaaggggaaacgtaaaccgttaaaaaccttttacccgttaaccccgtttaaccccttaaagttaaacgtttaaaccggtaaccggtaaacggtaagggttaaaccgttagggtttacttttttaaaccgg

SEQ ID NO: 436514 - DNA, 739 bp, Homo sapiens
  misc_feature: GZ8MTXP02F104C.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgaagggcttggaggtggagtgggatggatcgagcaacttaacaagtaggaaaacacgaaaagtatacgacaacgtaataaacgtttcccgaaggggtaccagggtagtaccaattacaacgtacggaaacccaaacgaaacgaacaaaccgtaactacccgaacggaacgaccacccgttacgaccccttaacgaaagtcggggtaaaaccttagggaaacgggtaaacccgttggaaacgtaacgtaccggtaacggaaccggaaccggtaaccgggttaacctttaagtttaaatttacggtttacggttaggaccggtaaagtaaacggttaaaacttaaaaaccgttttcccttaaaccttaacgttaaacttaacgtttaaacccggtaaacggttagttaaccggggtaaaagtttcggtttaccttttttaacg

SEQ ID NO: 436515 - DNA, 700 bp, Homo sapiens
  misc_feature: GZ8MTXP02GNLEZ.38.25.C03.1.454.CMB.2.raw
  modified_base (354)..(354): a, c, t, g, unknown or other
  modified_base (384)..(384): a, c, t, g, unknown or other
  modified_base (397)..(397): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacgaggcccctggacgaagggtcttgagtggatgggatggatcagcacttacaataggaaacacaaagtanagacacaataactttcagggtacagagtanatcatagaaccanaagacaacataccaacgagacactacgaccctaacaacgtacggaaacgttacggaaacgggtaaaccctaggtaaacgaacgttaccgtaacgggaaaccggtaaccgaaaccggggttaaccctttaaaattaaacgttttaacgtttaggttacgggtaaaccggaaacgggtaaaggtaaaacccttaaaactttacccccgttaaaccctttaaacttaaaacctttaaaagtttaaacccggaaaacggttaacggttaaggggtaaaaccgtttagggttaaccttttttaaaacg

SEQ ID NO: 436516 - DNA, 617 bp, Homo sapiens
  misc_feature: GZ8MTXP02G8BKP.38.25.C03.1.454.CMB.2.raw
  modified_base (218)..(218): a, c, t, g, unknown or other
  modified_base (412)..(412): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctnagtgaacgtctcctgcaaggcttctggttactacttttagctagttatggtgtcagctgggtgcgacaggcccctggacaagggcttgagtggagtgggatggatcgagcattacaataggaaaacacgaaaagtatcgacaactaataactttaccgaaggggacaggtacgtcaattacaatcgaaaccaanaacgacaactacaccacgaagcactcgacctaagacgtacgggaaactcgaaagggtaaaccctaggaagtattacgacgaaacggaccgaaccggttaccttaaagttatttattaggtcgacggaagaacgaaactaaaactttcctacctttaacaaacttaacgtacggtaaacgacgtaggaagtacgttacttttaacg

SEQ ID NO: 436517 - DNA, 659 bp, Homo sapiens
  misc_feature: GZ8MTXP02GFD68.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagacggccgtggggcctcagtgaacgtctcctgcaaggcttctggttactacttttagctagttagtggtgtcagtcgtgggtgcgacgacggcccgtaggacgagggcttggaggtggagtgggagtggatcgagactaacttaacgaagtacggaaaacaacgtaaaagtatacgactaactaattaaacgtttaccgaacggggtacagggtaactacgtaacgttaccgaactacgaaccaacgaacgaaacaacgactaacccaacggacgacctaccgtacgtaccttaacgacgttaacggaaacgtacggtaaacggaccgttagaacgtacgttacgacgaaccgacgtacggtacctttaatatttagtgtacgacggaaagtaacgtaaactaaacttcctaacgttactaataagtacgacgtagtacgtagttctacttttacg

SEQ ID NO: 436518 - DNA, 632 bp, Homo sapiens
  misc_feature: GZ8MTXP02HXSCL.38.25.C03.1.454.CMB.2.raw
  modified_base (218)..(218): a, c, t, g, unknown or other
  modified_base (323)..(323): a, c, t, g, unknown or other
  modified_base (446)..(446): a, c, t, g, unknown or other
  modified_base (468)..(468): a, c, t, g, unknown or other
  modified_base (474)..(474): a, c, t, g, unknown or other
  modified_base (593)..(593): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctnagtgaacgtctcctggcaaggtcttcgtggttactactttttagctagtttatggttgtcaggtcgtgggtgcgacacgggccccctggacaagggcttggaggnggagtgggatgggatcgagtactacgttaacgaaagtacggaaaaactaacgtaaaaggtactagactaactaattaacgtttccgaaggggacagacgttacagttacgaatacgaaaccanaaacacaacaacgtaccacganacactnaaccctaacgagttacggaaactacggaaacgtaaccgtaggactacgtacgacgaacgacctaacggtacttaagtatttagttggtacgagagaacgaaacttactcctaccttaanaattaacgtacggaactagtagagttacgtttactttag

SEQ ID NO: 436519 - DNA, 791 bp, Homo sapiens
  misc_feature: GZ8MTXP02G612Y.38.25.C03.1.454.CMB.2.raw
tcagtcgatcacgtcacgaccggtgctcgatttagtagtgtagatttgggtttggggacccaaaaaccacacccctcattgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttagtggtgtcagcgtgggtcgcgacgacggccccgtaggacgaagggtcttggaggtggagtgggtaagtggatcgagacctaacttacgaagtaggaaaacctaacgtaaaagtacgtacgacctaactaaacgtttaacgtttacccggaacgggtacgtaaacgggtaacggttacctaacgttaacctaaacgttacccggaaacccctaaacgtaaaccggtaaacccgaaaccaaaccgttaaccccgaaaacggggtaccgaaaccctacccgggttaccaacccccgtaaagtaaccggttaaacgggaaacccggttaacgggaaaccggttaaaccgtacggtaacggtaaaccgtacggttaaccggtaaccgaaacgtaacccgggttaccttaaagtttacgtttacgttaggtaacggacgtaaacggtaacgtaaaaccttaacctttaaccgtacctttaaacaagtttaaccgtaacgtaccgtaagtacggtaagttacgttttacg

SEQ ID NO: 436520 - DNA, 707 bp, Homo sapiens
  misc_feature: GZ8MTXP02IN87B.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtcgtgggtgcgacgacggccccgtggacgaagggcttggagtggagtgggatggatcgagctacttacaagtaggaaaacacgaaaagtatacgacaactaattaaacgtttccgaaggggactaggacttcaagttaccaagtacgaaaccctaacgaacgaacaaccgtactacccgaacggtaacgaccgaacctacgaccttaaacgaacgttacggaaaccgttacggaaacggtaaacccgtaggaacgtacgttaccgaacgaaaccgaaccgtaacggttaacctttaagttaacgtttagttcggtaaggtacggaaaggtaaacgtaaaaccttaaacttttcccctaactttaacctaaagttaacgttaaccggaacgttaacggtaaggttaaccggtttagtttaaccgtttttaacg

SEQ ID NO: 436521 - DNA, 629 bp, Homo sapiens
  misc_feature: GZ8MTXP02FSXFV.38.25.C03.1.454.CMB.2.raw
  modified_base (417)..(417): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacgggcccctggacaagggcttggagtggatgggatggatcagcacttaacaataggaaaacaacaaagtatacgacaacaattaacgtttacccaggggtacaggagtacaattacattacgaaccanaacgacacagtacccaagacgtcacttcgaccttacgagttcggaaactacggaaacggaacctaggacgtaactcgtacggaaccgaccgtaacggtaccttaattagtttagttacgtagtacgaggaacgtaaaccttaaacttaccccttacttaactaacgtaaactttacggaaacgtacgtaggtaacgttagtactttttaacg

SEQ ID NO: 436522 - DNA, 593 bp, Homo sapiens
  misc_feature: GZ8MTXP02GSAYE.38.25.C03.1.454.CMB.2.raw
  modified_base (328)..(328): a, c, t, g, unknown or other
  modified_base (378)..(378): a, c, t, g, unknown or other
  modified_base (400)..(400): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagctgggtgcgacacggcccctggacaagggcttggagtggagtgggagtggatnagctacttacaataggaaaacacaaagtatgacatataattccagggacngagtcatcagtacacacgaganaccatcccaagacgacactcgacctaacataggaaactaggaaacgaccgttagagtactacgtaacgaccgtacgaccggtactttagtaagttagttgtacggacgaaagtacgtaaaccttaactttcctaaccttaacctagttaaacgttacggaaacgtaggtagtaggttacgttactttttaacg

SEQ ID NO: 436523 - DNA, 638 bp, Homo sapiens
  misc_feature: GZ8MTXP02JHYUK.38.25.C03.1.454.CMB.2.raw
  modified_base (360)..(360): a, c, t, g, unknown or other
  modified_base (422)..(422): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacaagggtcttggagtggagtgggatggatcgagcacttacaagtaggaaaacacaaaagtntacgacacaataacttccgagggacagagtcaatacgaatcgaaccacaacgacacgtaacnccaacggacgacacgtcgacctaacgacgtacggaaactaggaaacggtaaaccgtagaacgtacgttacgacggaaccggaaccgtaacgggtaaccctttaagtaagtttagttggtaacgacggaaagtaacgtaaactaaactttaccctaccttaataaacttaagttaacccgtaacgtacgtaggtaacttacggttactttttaaacg

SEQ ID NO: 436524 - DNA, 695 bp, Homo sapiens
  misc_feature: GZ8MTXP02JUUBH.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacgttttagctagttatggtgtcagcgtgggtgaccggacgacggccccgtggaaccgaaggggtcttaggaggtggagtgggagtggaatcgagtctaacttaacaagtaacggaaaacaacgaaaaggtatacggacctaaactaattaacgtttccggaagggtacacggtaacgtactacttacaagtaccgaaaccaaacgaacgaaccaaacctacgtacccaacggaactaccaaccgtacgaccctaaacgagtacggaatacgggaaacggaaccttaggatacgttcgaacgacgaaccgtacggtactttaatagtttaacgtggtacgacgaaaggaaacgtaaacttaaaacctttcccgttaaaccttaacctaagtttaacgtaacgaacgttacggtaaggtaacggtttactacgtttttaaacg

SEQ ID NO: 436525 - DNA, 679 bp, Homo sapiens
  misc_feature: GZ8MTXP02HRS4J.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacaagggcttggagtggagtgggatggatcgagctaacttaacaagtaggaaaaacaacgtaaaagtatacggacaaactaattaaacgtttcccgaaggggacagggtaactaccaattcaagtacgaaacccaacaaacgaaaccaactactacccgaacgaacgacctaactcgaccttaaaccgagttacgggaaaccttagggaaacgtaaaccgttaggaacgtacgtaccgtaggaaacccgaaccgtaacccgggttacctttaattaagtttaacgtggttacgaccggtaagaaacgtaaacctaaacttccttaacccttaataacttaacgttaaccgaacgtagtacggtaagtcgtttacttttaag

SEQ ID NO: 436526 - DNA, 657 bp, Homo sapiens
  misc_feature: GZ8MTXP02IJVCO.38.25.C03.1.454.CMB.2.raw
  modified_base (369)..(369): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagcgtgggtgcgacaggcccctggacaagggcttggagtggagtgggatggatcgagactaacgttaacaaagtagggaaaaccaacgtaaaaaggtntacgaaccaactaattaaactttcccgaaggggccaggacgtacatacatcgaaccacaaagacactacacccgaacgagacactcgacctaacagtggaaactggaaacgtaaccgtggaacgtcgtacgtacgaaaccgtacgtacggttacctttaagttatttaaacggttgtacggacgttaaggaaactaaacttaaaacctttcccttaaacgtttaacaaacgtttaacgtaacccggtaacgttaacggtaaggtaacgtttcgttaacctttttaacg

SEQ ID NO: 436527 - DNA, 541 bp, Homo sapiens
  misc_feature: GZ8MTXP02IFLCW.38.25.C03.1.454.CMB.2.raw
  modified_base (348)..(348): a, c, t, g, unknown or other
  modified_base (450)..(450): a, c, t, g, unknown or other
tcagtcgatcacgtcacgaccggtgctcgatttagtagtgtagatttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttacgcttggtaccagcagaaaccaggacagcctcctaagttgctcatttactgggcatctacccgggagtccggggtccctgaccgnttcagcggcagcggtctgagacagatttcactctcaccatcagcagcctgcagctgagatggtgctagtttatacgtgtacagcagtattatagtagtcctnacgttacgttttggggacccgggggtaacaacggtccgtacgggagtacgtaaccgaaaacggtaacgtggtcgtacgtacggacctaacc

SEQ ID NO: 436528 - DNA, 741 bp, Homo sapiens
  misc_feature: GZ8MTXP02H2JVS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagcgtgggtgcgacgacggcccccgtggaacgaagggtcttaggaggtggagtgggatggatcgagctacttacaataggaaaaactacaaaagtatcgacaactattaaactttccgaaggggactagggaatacaactccgaatcgaaaccaaacgacgaaaccactacacccgaacgaacgtcctaaccgtcgaaccctaacaagtacggtaaaccgttaagggacggtaaaacccgttgggaaaacgtacgtttaccgtacggaaaccggtaccgtaaaccgggtccttttaaaacgttagtttaaccgtttaggttacggaaaccggttagggaaaaccgtaaaacgttaaaaaccgttttcccgtaacccctttttaaaacgtaaacgttttaaaccgttaaaccggtaaaaccggttacggttaacgggtttaaacggtttacggtttaacgtttttaacg

SEQ ID NO: 436529 - DNA, 648 bp, Homo sapiens
  misc_feature: GZ8MTXP02HLMVY.38.25.C03.1.454.CMB.2.raw
  modified_base (359)..(359): a, c, t, g, unknown or other
  modified_base (366)..(366): a, c, t, g, unknown or other
  modified_base (417)..(417): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaggcttctggttactacttttagctagttagtggtgtcagcgtgggtgcgacgacggccccgtggacgaagggcttgaggtggagtgggatgggatcgagacaacttaacaagtaggaaaacanaaagtanacgacataattaacttacgaggacagagtacatacaatacgaaccaacaanaaccaacacaccgaacgacgaccaccgtacgacctaagacgtaacggtaaacgtaggaaaccggtaaaccgtgaagtacgtaccgtacggaaacgtacgtaaccggttaacttaagttaattagttacggacgacggaaagtaaacgtaaaccttaaacttaccctaacgttaactaacgttaaacgttaaacgaacgtaacgttaggtaacgtttacgtttaacttttag

SEQ ID NO: 436530 - DNA, 706 bp, Homo sapiens
  misc_feature: GZ8MTXP02IISF4.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcgagcgtgggtgcgacgacggccccgtaggacgaagggtcttggaggtggagtgggatggatcgagactaacgttaacaaagtacggaaaacaactaaaagtatacgacaactaattaactttacgagggcagtagtacatacaatcgaaaccacgaagaacaacactaccgaacgaacgacctaacctacgaccctaacaacgttacggaaacgtacggaaacggtaacccgttaggaacgtaacgttacgaacggaaaccgtaacgtaaccggttacctttaaatttaacgtttagttacggtacggtacgtaaacggtaaacgtaaaccttaaaaccgttttacccgttaaacctttaacgtaaactttaaacgtttaaaccggaaacggtaaagttaacgggtaacgtttaacgtttactttttaacg

SEQ ID NO: 436531 - DNA, 566 bp, Homo sapiens
  misc_feature: GZ8MTXP02JLD0V.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctggtgcgacaggcccctggacaagggcttgagtggatgggatggatcagcacttacaataggaaaacacaaaagtatagacacaataaatttccaaggggcaggagtcaatcaatgaaccacaagacaacaatccaacgagacaactgacctacatggaaactgaaggaaacctgaagatcagacgaacacggccttaataattaattgtgcgaaagacgaaacaaaacttcctaccctttaaacaattaaacgtttaacgaacgtaactaggaaacggttagactttttaa

SEQ ID NO: 436532 - DNA, 791 bp, Homo sapiens
  misc_feature: GZ8MTXP02GHLHM.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacgttttagctagttatggtgtcgagtcgtgggtgcgacgacggcccccgtggaaccgaaggggtcttaggaggtggagttcggggattggatcgagtcctaacgtttaaccaagttacgggaaaactaacgaaaagtataccgaccaaactaagttaaacgtttcccggaaggggtccagggtaacgtctaagttaccaagtaccgaaacccaacaaacgacctaaaccaactacccggaaacgaaccgtaccaccggttacgaacccctaagtacgtaacggaaaccgtgggaaaccgtaaccgtgtaaccgtacggttacctacggaaacccggtacccgtaaacggggttacccttttaaattaacgttttaacggttaggtacggaaaaccggtaaggtaaaacccggttaaaaccttaaaaacccggttttcccccgttaaaccgtttaaaaccttaaatttaaacggttaaaccccggtaaggtaaaaccggttaagggttacggttaacgtttacggttttttaaacccg

SEQ ID NO: 436533 - DNA, 782 bp, Homo sapiens
  misc_feature: GZ8MTXP02FZLN4.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccagtttcaattggtgcagtctggagctgcggtgaagaggcctggggcctcagtgaacgtctcctgcaaggcttctggttacacttttagctagttatggtgtcagcgtgggtgcgacgacggccccgtggacgaagggcttggaggtggagtgggagtggatcgagcacttacaataggaaacaacaaaagtatacgacaactaattaaacgtttaccgaagggtaccaggaacgtacaactacaattacggaaacccaacaaacgacaacactacccgaacgacgaccactacgaccctaacgacgtaaggaaaccgttaggaaacggtaaacccgttagaacggtaacgttaccgtacggaaaccggtaacccgtaaccggggttaacccttttaaacgttaacgttttaacggtttaggttacgggaacccgggtaaaaggtaaaccgggttaaaaaccgttaaaaacccgttttacccccgtttaaacccgttttaaaacccttaaaacgtttaaaaccggttttaaaacccccgggtaaaacggttaaaagggtttaaccggggtttaaaagggtttaccggtttaaaccgtttttttttaaaacccgg

SEQ ID NO: 436534 - DNA, 690 bp, Homo sapiens
  misc_feature: GZ8MTXP02G1VBJ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggccgtggggcctcagtgacgtctcctgcaggtcttctggttactacttttagctagttagtggtgtcaggtcgtgggtcgcgacgaccggccccgtaggacgtaagggtcttaggaggtcggtaggtggggagtggtaacgtcgaggtactaacgtttaacgaagtaacggaaaactaacgtaaaaggttacacgtaccaacttaaagttaacgtttaccggaaggggtactagggtactacgtaacgttaccgagtaccgaaaccaacgaacgaacaacgtacgacccgaaacgcgacctaacgtccgtaacccgtaagaacggttacggaaaaccgttcggaaacggtaaccgttagacgtacgtaccgtacggaaccgtacgtacgttaactttatagttgtacgtcgacgaatacgtaaactaaccttctaacttagtataacgtacgaacgtagtacgtaagttcgttacttttaacg

SEQ ID NO: 436535 - DNA, 630 bp, Homo sapiens
  misc_feature: GZ8MTXP02GDFHO.38.25.C03.1.454.CMB.2.raw
  modified_base (425)..(425): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacgaagggcttgaggtggatgggatggatcgagcaacttacaaagtggaaaacacgaaaagtactagacaactaattaaatttcccgaaggggacctaggtagtacctaatacgaatacgaacccaanaacgacaaacactacccgacgaacgacacctcgaccctacagtacggaaactggaaacggaacctagaacgtaacgtctacgaaccgaccgtaacggtaccttaatagtttaagttgagacgaagaacgaaactaaactttcctaccttaactaattaaacgttaaccgaacgtaacgtaggtaaggttacgttactttttaacg

SEQ ID NO: 436536 - DNA, 628 bp, Homo sapiens
  misc_feature: GZ8MTXP02G498T.38.25.C03.1.454.CMB.2.raw
  modified_base (427)..(427): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttctggttactacttttagctagttatggtgtcagcgtgggtcgcgacgacggcccctggacgaagggcttgagtggagtgggatggatcgagctaacttacgaagtaggaaaactaacaaagtatacgacactaaataactttccggaaggacaggtactacatacaagtacgaaccaacgaanacaactacacccgaacgacgacctactcgtaaccctaacacgttacgggaaactggaaacgacgtagaagtacgttacgtacgaaccggaacgtacggtacctttaatacgtttagttacggtagacgaaagactaacttaaacttccgttaactaacttataacgttacgtacgtatagggaacttcgttacttttaacg

SEQ ID NO: 436537 - DNA, 669 bp, Homo sapiens
  misc_feature: GZ8MTXP02HJCDY.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttatggtgtcagcgtgggtgcgacgacggcccctaggacgaagggctgaccgtggagtgggatggatcagcacttagaataggaaacaacgaaagtatacgacaactaattaaactttcgacgggcaggacgttacatacaatacgaaccaacgaacgacacctaacaccgaacgagacctaccgacgacctaacgacgtaggaaaccgtaaggaacgaaaccgttaggaacgacttaccgacgaacggtaaccgaccggttaccttaagtttaacttaaggttacgttacggaaccggtaaagtaaacggtaaaccttaaaccgtttacccttaaccgtttaacctaaagttaacgttaaccgtaacggtaacgttaagggtaacttcggttactttttaacgg

SEQ ID NO: 436538 - DNA, 603 bp, Homo sapiens
  misc_feature: GZ8MTXP02JV8GV.38.25.C03.1.454.CMB.2.raw
  modified_base (351)..(351): a, c, t, g, unknown or other
  modified_base (358)..(358): a, c, t, g, unknown or other
  modified_base (448)..(448): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttacacttttagctagttatggtgtcagcgtggtgcgacaggcccctggacaagggcttgagtggagtgggatggatcagcactacgaataggaaacacaaagtntcgacanataacttccgaggctagagtacatacgaagtacgaacacaacaccaaacacaccacgacgacaccgtcgacccttaagacgtcggaaacnggaaacgtaccgtgaacgtacgactacggaaccgaacgaccggtaaccttataagttacgttacgtggaacggagaacgtaaacctaaacttacccttacttactaacgttaactacgaaaccggttacaggtaaacggttcttagtttttaccg

SEQ ID NO: 436539 - DNA, 517 bp, Homo sapiens
  misc_feature: GZ8MTXP02FFTLK.38.25.C03.1.454.CMB.2.raw
  modified_base (384)..(384): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcactacaataggaaacacaaagtatgcacataatttccagggcagagtcatcatgaccanagacacatccacgagacactgacctacatggaaactggagacctgagatctagacgacacggccttatattatgtgacgagaagactaaacttcctactacataagttacgacgataggaagtcgtactttac

SEQ ID NO: 436540 - DNA, 537 bp, Homo sapiens
  misc_feature: GZ8MTXP02FL88Z.38.25.C03.1.454.CMB.2.raw
  modified_base (376)..(376): a, c, t, g, unknown or other
  modified_base (392)..(392): a, c, t, g, unknown or other
  modified_base (436)..(436): a, c, t, g, unknown or other
  modified_base (456)..(456): a, c, t, g, unknown or other
  modified_base (478)..(478): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggatgggatggatcagcacttacaatggaaaacacaaaagtatgacacaataaatttccaaggggtcngagtcatcatgaccanagacacatccaacgagcactgctacatgaactgagaactgaganctgacgacacgggccttaanatttaatgtcgacgaaggaaanaaactaaacttacctaccttacaataacgttaacgaacgtagtaggaacgtgtacttta

SEQ ID NO: 436541 - DNA, 712 bp, Homo sapiens
  misc_feature: GZ8MTXP02FKXXZ.38.25.C03.1.454.CMB.2.raw
  modified_base (282)..(282): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccacctcccaggttcaattggtgcagtctggagctgcggtgaaggaggccgtggggcctcagtcgaacgtctcctgcaaggtcttcgtggttactacttttagctagttatggtgttacgngtgtggtgacgacgcggcccgtaggacgagggtcgttaggaggtggagtgggagtggatacgagtactaacttaaacgaaagtaaacggaaaacaaagtaaaagtagacgaactaaacgtaaatttaaaccgtttacggaacgggactaggtacgtactaactacgtaacgtacgaaaccaaacaaacgaaacccaactaaccgaaccgaacgaaccgaccaaccgtacgaacccgtaagtaaacgtacggtaaacgtagggaaacgtaaccgtaggtaacgtacgtacgtaacggaccgaaccgtacgttaacttaattaacgtttagtcgtaacgacgtaaagtaactaaaccttaaactttacccttaacttaactaaagttaacgtaacggtaacgtacgtaggtaacgttacgtttacttttacg

SEQ ID NO: 436542 - DNA, 572 bp, Homo sapiens
  misc_feature: GZ8MTXP02JD5BW.38.25.C03.1.454.CMB.2.raw
  modified_base (325)..(325): a, c, t, g, unknown or other
  modified_base (417)..(417): a, c, t, g, unknown or other
  modified_base (448)..(448): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccaggtagttagttttacacgaggtaccaacaaataagaattactcgcttggtaccagcaagaaaccaggacagcctactaagtcgctcatttacgngggctacgtcgtacccgggacggtcccggggtcctgaccgcttccgagcggcaggcggtctggagacagtacttacgactcacaccatcgancacgcctgcacggactagatgtaggtacgtnttagtttagtacttagtccgtagtctaagttaattaagtacgtagtccctagtacggttacgtttcggggaccgggtaactaacggcgtacgagtacaacgaacgtagtcgagcgtacgctacg

SEQ ID NO: 436543 - DNA, 648 bp, Homo sapiens
  misc_feature: GZ8MTXP02G5QDX.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagcgtgggtgcgacacggcccctaggaccaaggtcttggaggtggagtgggatggatcgagctaacttaacaagtacggaaaacacgaaaagtatcgacaactattaactttccgaagggcaggtagtcaatcgaatacgaaccaacaacgaacaactacaccgaacgacgacactcgaccctaagagtacggaaaccgtaggaaacgaaccgtagacgactcgacgaacgaccgtacggtaccttaagttatttagttcggtagaccggtaagtaaaccgtaaacttaaaacctttccccttaaccttaacctaaatttaacgttaaccggtaacgtaagttaggtaaacggtttcttaaccgtttttaacg

SEQ ID NO: 436544 - DNA, 655 bp, Homo sapiens
  misc_feature: GZ8MTXP02IQVFT.38.25.C03.1.454.CMB.2.raw
  modified_base (359)..(359): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggcctggggcctcagtgaacgtctcctgcaaggcttctggttactacttttagctagttatggtgtcaggcgtgggtggcgacacggcccctggacgaagggcttaggagtggagtgggatggatcgagcactttaacaagtaggaaaacaanaaaagtatagacaactaattaaacgtttcgaagggcagtaagtcaactacaagtcgaaaccacaagacaacactccaacgagactaactcgacctaacgagtacggtaaactacggaaacggtaaacccgttaggaacgtacttaccgtacggaaaccggtaaccgtaaccggtaaccctttaattaatttacgtggttaacgacgtaagacgtaaaacttaaacgtttccctaacctttaacgacttaacgttaaaccgacgtaacgtaggtaacgtttcgttacgtttttaacg

SEQ ID NO: 436545 - DNA, 528 bp, Homo sapiens
  misc_feature: GZ8MTXP02FP1ST.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaaggggcttgagtggatgggatggatcagcacttacaataggaaacacaaagtatagacacataactttccgagggtcagagtcatcatgaccacagacacataccacgagcactgcctacatggaaactgaagacctgagatctgaccgacacggtccttatattagttgtgcgagacgaactaaacttcctaccttaacataacgtacgacgataggaatacgcttttaac

SEQ ID NO: 436546 - DNA, 697 bp, Homo sapiens
  misc_feature: GZ8MTXP02ISE1R.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggcctggggcctcagtgaacgtctcctgcaaggcttctggttactacttttagctagttatggtgtcagcgtgggtgcgacacggcccctggacgaagggcttggaggtggagtgggatggatcgagctaacttacaataggaaaacacgaaaagtatcgacaactaattaaacgttccgaaggggtcaggtacgttacaagtcaatacgaaaccctaacgaacgaaccaacaactaccccgaacggaacgtaccaaccctacggaccccttaacgaagttacggaaaacctaggaaacgggtaaacccgtaggaacggtaacttaccgaaggaaaccccggtaacgtaacccgggtacctttaaagttaactttacgtagggttacgacggtaaagtaaacgtaaaacctaaactttccctaaccgttaaactaacttaaacggtaaccgtaacggtagtacggggtaaacttcggttaactttttaacg

SEQ ID NO: 436547 - DNA, 686 bp, Homo sapiens
  misc_feature: GZ8MTXP02GO0YK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggcttctggttacacttttagctagttatggtgtcagcgtgggtgcgacgacggcccctggacaagggcttggagtggagtgggatggatcgagcaacttaacaagtaggaaaacaacgtaaaagtatacgacaactaattaaacgtttccgaaggggaccaggtaacgtcaaagtacctaagtacgaaacccaacgaacgaaccaaacctactacccgaaacgaacgacctaacgtacgaccctaacagtaacgggaaacttacgggaaacggaaacccgttagggaacgtaacttacgaacgtaaccggaaccgtaacggttacccgtttaattaacgtttagttaggttacggacgtaagtaaacgtaaaccttaaactttccctaacttaacgtaattaacggtaaccgtagtaacgtaggtaacggttcgttaacttttaaccg

SEQ ID NO: 436548 - DNA, 727 bp, Homo sapiens
  misc_feature: GZ8MTXP02GLJ6A.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggctgagtggagtgggatggatcgagcacttacaagttaggaaaacacaaagtatacgacactaattaaactttccgaaggggtaccaggtacgtaccaagttaccaagttacggaaaccaaacaacgaaccaacaactacccaacggagaccacttacgacccgttaacacgttacgggaaaccttagggaaacgggtaacccgttaggaacggtacgtaccgttaacggaaccggtaacccggtaaccgggtaccctttaaacgttacgtttaaacgttggttacgggacggtaaacggtaaacgggtaaaccgtaaaaccgtttaccccgttaaaccctttaacgtaaactttaaacgtttaaacccgggtaaacggttaacggttaagggtaaacggtttaccggttaacgttttttaaaccg

SEQ ID NO: 436549 - DNA, 751 bp, Homo sapiens
  misc_feature: GZ8MTXP02I18BT.38.25.C03.1.454.CMB.2.raw
  modified_base (342)..(342): a, c, t, g, unknown or other
  modified_base (349)..(349): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacacggcccctggacagggcttgagtggagtgggatggatcagctactacatggaaacanaaagtanagtaccactaataactttccgaagggtcaggtagtacaagtcagttacgaaccgacaagacaccaactacccgaacgaacgacctaccgtacgtaccccttaaacgaacgtacgggtaaaacgttacgggaaacgggtaaacccccgtttaggaaacggttacgttaaccgttacgggaaacccggtaaccgtaacccgggggtaaacccctttttaacggttaaattttacgttttaagggttacggaacggtaaacgggttaaacggtaaaaccttaaaaacttttacccccgtttaaacccgtttaaacgtaaaacctttaaacgtttaaacccggtaaaaccggttaaacggttaaggggttaaaacggtttacgggtttaacctttttttaaaccgg

SEQ ID NO: 436550 - DNA, 609 bp, Homo sapiens
  misc_feature: GZ8MTXP02JC04I.38.25.C03.1.454.CMB.2.raw
  modified_base (447)..(447): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagctgggtgcgacacggcccctggacgaagggcttgaggtggagtgggatggatcgagcacttacaagtggaaaacacaaagtatacgactaactaattaactttccgaaggggcaggtacgtacagtacatacgaccacaacgacaacactaccacgacgacactacgacctaanagtacggaaacgtcggaaacggacccgtagagtactacgtacgaaccgaccgacggtactttattaagttagtggtacgacgtaacgaacgtaaactaaacttccctaaccttacaacgttaacgtaacgaacgttagtacggtagtacgttacttttaacg

SEQ ID NO: 436551 - DNA, 694 bp, Homo sapiens
  misc_feature: GZ8MTXP02JH61O.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtggtgcgacacggcccctggacgaagggtcttggaggtggagtgggagtggatcagctacttacaatacgggaaaacacgaaaagtatacgactaacgattaaacgttttccgaaggggtaccagggtacgtactaaacgtactagttaacggaaacccaacgaaacgaccaaaccgtaactacccgaaacgggacgacccaaacccgttcggaaccccttaaacgaacgttacgggaaaaccttagggaaacggtaaacccgttaggaaacgtaacgtaccgtaacgaaccggaccgtaaccgggtacctttaattaacgttagtcggtacgagtaaagaaacgtaaactaaactttccctaaaccttacaacgttaactaaccgaacgtagtacggaagttcgttacttttaag

SEQ ID NO: 436552 - DNA, 753 bp, Homo sapiens
  misc_feature: GZ8MTXP02F13F5.38.25.C03.1.454.CMB.2.raw
  modified_base (373)..(373): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaaggaggccgtggggcctcagtgaacgtctcctgcaaggtcttctggttactacttttagctagttatggtgttcagtcgtgggtgcgacgacggcccctggaacgaaggggtcttggaggtggagtgggatggatcgagcaacttacaaagtaggaaaaccagaaaagtntacgacaactaattaaacgtttaccgaaggggacagggtactacctaaattaccgaagttaccgaaaccaacaaacgaaaccaaacccgaactaaccccgaaagacggacaaccgtacgaccttaacaagttacggaaacgttaggaaacgggtaaaccctaggaacgtaacgttacaaaccggaaccggaaccgtaaccggggttaacctttaacgttaaagttttaacgttacggtaagggtaccggtaaaaggtaaaccggtaaaacttaaacctttaccccgttaaacctttaaactaaacgtttaaaacggttaaacccgtaaacggttaaacggttaacggttaaaacgggttttacgttttaacgttttaacg

SEQ ID NO: 436553 - DNA, 714 bp, Homo sapiens
  misc_feature: GZ8MTXP02H7F0A.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttagtggtgtcaggtcgtgggtcgacgacgacggcccccgtaggacgaagggtcttggaggtggagtgggatggatcgagtactacgttaacaagtaggaaaacaacgaaaggtatacgactaactaataacgtttcgaagggacagtaagtacacttacgaagacgaaccaacaacgaacaaactacaccgaaacgacgaccaacgtctaacccaacgacgttaacggaaacttagggaaaaccgtaaccgttagaacgtacgtaccggtagaaaccggaacgtaccggtactttaagttaacgtttacgtaaggttcgaaacggttaaagggaaacctaaacgtttaaaccctttacccgtaaccttttaaacctaagtttaaaaccgtttaaccggaaacgttaacgggttaaaggttaaaaccggttttacgttttaacgttttacg

SEQ ID NO: 436554 - DNA, 792 bp, Homo sapiens
  misc_feature: GZ8MTXP02IV2FD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacaggcccctggacagggcttgaggtggagtgggatggatcgagcacttacaatacggaaaacacgaaaagtatacgaccaactaattaaacgttttacccgaaggggtaccaggggtaacgttaccgaacttaccgaagttacgaaaccccgaaacaacggaaaccaaccctaactacccgaaacggaacggacctaacccgtacgaccccgttaacaaacgttacgggtaaaaccgtaacgggaaacgggtaaaaccccgttggaaaccggtacgttacccgtaacggaacccggtaaaccgtaacccggggttaacccttttaaaggtttaaacttttagtttacggttaagggaccggtaaagggtaacggttaaaaccgttaaaaccttttccccgtttaaaccctttaaacttaaacgtttaaaacgtttaaacccggtaaacggtttaaaccggttaaggggttaaaacggtttacggtttaacttttttttaaaccgg

SEQ ID NO: 436555 - DNA, 604 bp, Homo sapiens
  misc_feature: GZ8MTXP02JBLE1.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagcgtgggtgcgacacggcccctggacaagggcttgaggtggagtgggatggatcgagcacttacaagtaggaaacacaaaagtatacgacaactataactttccgagggcagagtcatacatacgaccacagacacactaccagacgcactcgacctaacagtaggaaacctaggaacggaaacccgttggaacgtactacgtacgaaccgaacgacgggtaccttagttaatttagtgtacggtacgaaggtaacgtaaactaaactttccctaaccttaactaaagttaacttaacgacgtagtacggtaaagttcgtactttttacg

SEQ ID NO: 436556 - DNA, 653 bp, Homo sapiens
  misc_feature: GZ8MTXP02FXQ5O.38.25.C03.1.454.CMB.2.raw
  modified_base (458)..(458): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggccgtggggcctcagtgaacgtctcctgcgaaggtcttcgtggttactacttttagctagttatggtgtcagcgtggtgcgacgacggccccgtggacgaagggtcttggagtggagtgggatggatcgagctacttacaagtacggaaaacaacgtaaagtatcgacaactaattaacttaccgaggacagtagtacaatcaagtacgacccaagacgaacacaactcgaacgacgacacctcgaccctaanaggtacgaaacgtagaaacgggtaacctggaactacgtactacggaaccgtaaccgtaccggttacctttaagttaacgtttagttacggtaggacgtaaagtaacgtaaaccttaaactttcccttaaacttaactaaacgttaacgtttaaccgaaggttaacgttaggtaacgttacgtttactttttaacg

SEQ ID NO: 436557 - DNA, 665 bp, Homo sapiens
  misc_feature: GZ8MTXP02ISTPB.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctaggacgaagggtcttaggaggtggagtgggatggatcagctacttacaagtaggaaaacacaaaagtatacgacaactaattaactttccgaaggggcaggtacgtcaatacaagttcgaaacccgaacaacgaaccaacaactacccgaacgaacgacaccgtacgaccctaagaacgtacggaaactacgggaaacggtaaacccgtagaacgtagttaccgtaggaaccgacgaccggtacctttaattaaagtttagttaggtacgtacggtaaagaacgtaaaaccttaaactttccccttacctttaacaaatttaacgtaaacggtaacgtaacgtaggtaaacgttgttactttttaacg

SEQ ID NO: 436558 - DNA, 534 bp, Homo sapiens
  misc_feature: GZ8MTXP02I2JCL.38.25.C03.1.454.CMB.2.raw
  modified_base (433)..(433): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcacttacaataggaaaacacaaagtatcgacacataaattccagggacagagtcatcatgaccacagacacatccagagcactcgctacatgaactgaaggacctganatactagacgacacgcttatattatcgtgacgagaacgtaactaaacttcctaccttaacattaacgtaacgaacgtacgtaggaaacgttcttactttac

SEQ ID NO: 436559 - DNA, 706 bp, Homo sapiens
  misc_feature: GZ8MTXP02HMV9A.38.25.C03.1.454.CMB.2.raw
  modified_base (369)..(369): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagcgtgcggtgaaggaggccgtggggcctcagtgaacgtctcctgcaaggcttcgtggttactacttttagctagttatggtgtcagctggggtgcgacgacggcccctggacaagggtcttggagtggagtgggatgggatcagcaacttacaagtaggaaaaccagaaaagttanaccgactaactaattaacgttacggaaggacagtactactatacgaagtaccgaaaccaacgaacgtaaccaaccgtaccgtacccgaaacggtacccgtacctaccgtaccgtaaccctaacgacggtaacggtaaacgtacggtaaacggtaaccgtaaggaacgtacgtaccgtaacggaaaccgtaaccgtacccggttaactttaagttaagtttacgttacggtacggaaacggtaaagtaaaccgtaaaccttaaaacctttccctaaccgttaacgtaacgttaaacgtaacggaacgtacggtaaggtactttacgtttacctttacg

SEQ ID NO: 436560 - DNA, 598 bp, Homo sapiens
  misc_feature: GZ8MTXP02J1RB4.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcaggtgaacgtctcctgcaaggcttctggttacacttttagcagttatggtgtcagcgtgggtgcgacgacggccccgtggacgaagggcttggaggtggatgggatggatcgagcacttacaagtaggaaaacacaaagtatcgacaactataactttccgagggtacagacgtcatacatacgaccacaagacacactaccaacgagaccacgtcgaccctaacagtaacgaacgtagaaacgggaacctgaagtactacgtacgaacgaaccgtacggtaccttaattacgtaattcggtacgaccgtaagacgtaactaacttcctaccttaacactaacgttaacgacgtacgtaggtagttacgtacttttacg

SEQ ID NO: 436561 - DNA, 580 bp, Homo sapiens
  misc_feature: GZ8MTXP02GRV6K.38.25.C03.1.454.CMB.2.raw
  modified_base (429)..(429): a, c, t, g, unknown or other
  modified_base (561)..(561): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggccccctggacaagggcttgagtggagtgggatggatcagcacttacaatggaaaacacaaaagtatgacacaataaactttccgaagggcagagtcaatcatagaccacagaacacactaccacgagaccactgacccttaanacgtacggaaactagaacgggtaaacctggaagacgtccgtacgaaccgacgtaacgggtacctttaataattattaggtcgacgagacgaaactaaacttccctacttaactaataacttaaccgacgtanagggtaatcgacttttaac

SEQ ID NO: 436562 - DNA, 686 bp, Homo sapiens
  misc_feature: GZ8MTXP02I5LLH.38.25.C03.1.454.CMB.2.raw
  modified_base (460)..(460): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtggtgcgacacggcccctggacaagggtcttggagtggagtgggatggatcgagtcacttacaataggaaaacactaaaaggtatacgacaactaattaaactttccgaaggggacaggtacgttacaaacttaccaagttacgaaaccaacgaaagaaccaaacctaacctacccaaccgganacctacctacgacccttaacgacgttacggaaacgtaggaaacggaaacccttaggaacggtacttaccgtaaggacccgaaacgtaccgggtaacctttattaaacgtttacgtaggttacggtacggaaaggtaaacgtaaaaccttaaaactttccccttaacctttaactaaattaaacgttaacgaaccgtaagtaggtaaacgtttcgtactttttaacg

SEQ ID NO: 436563 - DNA, 618 bp, Homo sapiens
  misc_feature: GZ8MTXP02F3CRD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagtcgtgggtgcgacacggcccctggacaagggctgagtggatgggatggatcagacacttacaagtaggaaaacacaaaagtatacgactaacgtataaacgtttccgaagggcaggagtacaatccatacgaccaacacgacaacacaccagacgacactcgcctacacaggaactagaacggtaaccgtgaatacgtactacgaccgaacgtaaccggtacctttaattaagtttaacgttacggtagtaccggaaagtaacggtaaacttaaaaccgtttcccctaacttaacctaattaacgtttaacgacgtagttacggaaacgtttgtactttttaacg

SEQ ID NO: 436564 - DNA, 549 bp, Homo sapiens
  misc_feature: GZ8MTXP02I4UR2.38.25.C03.1.454.CMB.2.raw
  modified_base (323)..(323): a, c, t, g, unknown or other
  modified_base (332)..(332): a, c, t, g, unknown or other
  modified_base (371)..(371): a, c, t, g, unknown or other
  modified_base (382)..(382): a, c, t, g, unknown or other
  modified_base (411)..(411): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatnagcacttanaatggaaacacaaagtatgcacataacttcaggcagatnatcatgaccanaagacacataccagagacactgacctaanatggaactgaacggacctagacgatcgtagacgtacacggtaccttataacttattgtagcgaagtacgaactaaaactttccctaacttaacctataacgtaacgtacgtaacgtaggtaacgttagtacttttaac

SEQ ID NO: 436565 - DNA, 538 bp, Homo sapiens
  misc_feature: GZ8MTXP02H42LS.38.25.C03.1.454.CMB.2.raw
  modified_base (396)..(396): a, c, t, g, unknown or other
  modified_base (426)..(426): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcagaggccaccatcaactgcaagtccagccagagttgtttacacaggtacaaacaataaagaattactcgcttggaaccagacaagaaaccaggacagcctacctaaagttgctcatttacgtggctatcgtaccgggagtccccggggtccctggaccgtactcgagccggacaggcgggtctgagacagtattcactcncaccatcagcacgctagcagcagagatagngctagtttatacgtgcagactagtatatagtacgtctacgtacgtacgtttacgggccgggtacacgtcgtacgagtaacgaacgaaacgacgtgtacgcgtacgaccaacg

SEQ ID NO: 436566 - DNA, 594 bp, Homo sapiens
  misc_feature: GZ8MTXP02F3S1X.38.25.C03.1.454.CMB.2.raw
  modified_base (421)..(421): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttatggtgtcagcgtgggtgcgacgacggccccgtggacgaagggtcttggaggtggagtgggatggatcgagcacttaacaagtaggaaaacacgaaaagtatacgacactaattaaactttccgaaggacagtagtacagtacatacgaaccaanagacaacataccaacgagcacgtcgacctagagtacggaaactaggaacgtaaccgtgaagtactacgacgacgactacggtacttatattattaggtacgacgagaacgtaaactaactttcctaacttactaataacgttacgaacgtagtaggtaactcgttacttttag

SEQ ID NO: 436567 - DNA, 678 bp, Homo sapiens
  misc_feature: GZ8MTXP02IWC9W.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagtcgtgggtgcgacgacggccccgtggacgaagggcttggaggtggagtggggatagggatcgaggctaaacgttaacaaagtagaaaaccaagaaaagtatacgacctaactaacttaacgttccgaaggggactaggtacgttacaacttaccgaagtcgaaaccaacggaaacaaacaacctaactaccggaaacacgactaaccgtcgaaccctaacgagtaacggtaaactacgggaaacgtaaccgttagaaggtacttacccgaaggaaccgaaacgtccggtaaacctttaattagtttagtggtaagacggtaaagaacttaaactaaacctttccctaaacttaataacgttaacgttaaacgacgtaagtagttaagtccgtatttttaacg

SEQ ID NO: 436568 - DNA, 747 bp, Homo sapiens
  misc_feature: GZ8MTXP02JC0H8.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacaggccccgtggaccaagggtcttggaggtggagtgggatggatcgagctaacttacaaagtacggaaaacaacgaaaagtatcgacaactaagttaaactttaccgaaggggtcaggtacgtacgaattcaatacggaaaccacgaacgaacaaccaacgtcccgaaacgacgaccaacgtcgacccttaacgaacgttacggaaaacctgggtaaaccgggaaacccgttagggaaacgtaacgtttaccgaacgggaaacccggaaccgtaaaccgggttaaccttttaaatttaaccgtttaagtttacgggtaggtaaccgggaaaggtaaacggtaaaaccttaaaaaccgttttcccgttaaaacccgttttaactaaaacgtttaaccgtttaaaaccggaaaaccggtacggttaacgggtaaacggtttacggttacgtttttttaaaccg

SEQ ID NO: 436569 - DNA, 649 bp, Homo sapiens
  misc_feature: GZ8MTXP02FOSAB.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttcgtggttactacttttagctagttatggtgtcgagcgtgggtgcgtacgacggccccgtaggacgaagggtcttaggaggtggagtgggactggatcgaggtctaacgttacaagtaggaaaacacaaagtatcgacaactaattaacgttaccgaggggtacagggtactacaagtacctaagtacgaacccaaaggaacacgaaacctactaccgaaccggaagaccaacgttacaccccgttaacgagttacgggaaacctggaaacgaaccgttagacgtattaccgagaaccggaccgtacgggttaaccttataagttgttgtacgagtagaaacgaacttaaacttccctaactacgtaataagttaaccgagttacgtaggtaactgttacttttacg

SEQ ID NO: 436570 - DNA, 676 bp, Homo sapiens
  misc_feature: GZ8MTXP02J21KP.38.25.C03.1.454.CMB.2.raw
  modified_base (220)..(220): a, c, t, g, unknown or other
  modified_base (617)..(617): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactccccaggttcaattggtgcagtctggagctgcggtgaagaggcctggggcctnagtgaacgtctcctgcaaggcttctggttacactttttagcagtttatggtgtcaggctgggtagcgacacggcccctggacaagggcttggagtggagtggatggatcagcattacaagtggaaacaacgaaagtatcgacactaacgttaatttccgaaggggcaggacacccattccaagtcgaaaccacgtaacgaccaactacaccccaacggaactccgtaacctcggtacccttaaaccgagttacgggaaaccttaggaaaccgggtaaccttgggaactacgtacgtacggaaccggaaccgtaaccgggtaccctttaaattactttaacgtttggtacggaccgaagggaacgtaaccttaaacgtttacccgtacccctttaaanaactttaacgttaaacgtaccgtaaggttaaccggtaacgttggtttactttttaacgg

SEQ ID NO: 436571 - DNA, 697 bp, Homo sapiens
  misc_feature: GZ8MTXP02IFUK5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacgacggcccctggacgaagggcttggaggtggagtgggatggatcgagcctaacttaacaaagtaggaaaaaccacgtaaaacgtatacgaccaactaattaaacgtttccgaaggggtaccagggtaacgttacaagttaccaagtacgaaccaaacaacgaacaaccactacccgaacggaacgacctaacgtcgaaccctaacgtaacgtacggaaacgtacgggaaacggtaacccgtaggaacgtacgtacgtacgaacccggaacgtaccggtactttaagttacgttagttcgtacgacgtaaagaacgtaaaccttaaactttcccgttaacctttaacgtaaacttaacgttaaccggaaacgttaggttaacggtaagtttcggtaacgttttttaaccg

SEQ ID NO: 436572 - DNA, 624 bp, Homo sapiens
  misc_feature: GZ8MTXP02H94QQ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctggttactacttttagctagttatggtgtcagctgggtgcgacgacggcccctggacgaagggcttggagtggagtgggatggatcagcacttacaagtaggaaacacaaaagtatgacactaataatttccgaggtacagaagtacattacaatacgaaccacaacgaacaacactacccaacgaacgacctaactacgaccctaacagtacggaaacctagggaacggaaacccttagagtactaccgtagaaccgaacgtaccggtacctttaattaatttagtttcgtacggacgaaggaacgtaaactaaactttaccctacctttaacattaaacgttacgtaaacgtagttaggtaaacgtggtttacttttaacg

SEQ ID NO: 436573 - DNA, 596 bp, Homo sapiens
  misc_feature: GZ8MTXP02JCUN2.38.25.C03.1.454.CMB.2.raw
  modified_base (398)..(398): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacaagggcttgagtggagtgggatggatcgagcacttacgaataggaaacacaaagtatcgacactaataactttcgaagggtcagagtcatcatgaccanagacacataccacgagccaactcgaccctaacgatacggaaacgttacgaaagggtaacccttgaacggtacttaccgtagaaccggtaacgtaccggtaccttaattaattagttgtacgacgaagtacgaaacttaaacttcctaccttaacaattaacgttaacgaacgtagtaggtaagttcgtactttttaac

SEQ ID NO: 436574 - DNA, 628 bp, Homo sapiens
  misc_feature: GZ8MTXP02I25PX.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacaagggcttgaggtggagtgggatggatcagctacttacaagtaggaaaacaacgaaaagtatacgacaactaattaaacgtttccgaagggacagagtacaagtcatacgaaccacacgaacacactaccgacgagcactcgacctacagtacggaaactgaaacggtaacctgacgtactacgtacgaccgaacaccggtacctttaagttatttagttacggtacggtacgaagtaacgaaaccttaaacctttacccttaacctttaactaactttaaacgttaacgaacgtaacgtagggtaaacttcggtttacctttttaacg

SEQ ID NO: 436575 - DNA, 685 bp, Homo sapiens
  misc_feature: GZ8MTXP02GONJL.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtgggcctcagtgaacgtctcctgcaaggcttctggttacacttttagctagttatggtgtcaggcgtgggtgcgacgacggcccctggacaaggggcttgagtggagtgggatggatcgaggctaacttacgaaataggaaaacaacgaaagtatcgactaactaataaactttccgaaggggactaggacgtactaataccatacggaaaccacgaacgaacaacgaactacccgaaggaacaccaacctcgtaacccgaacagttacggaaacgtggtaaacggaaccctgggaactagtacgtacgaacccgtacgtaacggtacctttaagtaacgtttacgtgggttagtaccggaaaggtaaaccggtaaacttaaaacgttttaccccgttaaacccgttacgttaaaattaaccgttaaaggaaaccgtaaaggtaccggttaagtttacggtacttttttaaacgg

SEQ ID NO: 436576 - DNA, 631 bp, Homo sapiens
  misc_feature: GZ8MTXP02IBSXV.38.25.C03.1.454.CMB.2.raw
  modified_base (581)..(581): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacaggcccctggacaagggcttggagtggagtgggatgggatcgagctaacttacaagtacggaaaacacaaagtatcgacctaataatttaaactttccgaaggggtccagggacttacaacgttcgaatacgaaccaaacaacgaacaaccactacccaacgacgacaccttacgaccctaacgagtacgaaaccgtaggaaccgaaacctgaactatccgtagaacgacgtacgtaccttaatagtttaagtgtacgacgaaagtacgaaacttaaacttcccttaaccttanaaacgttaacgttaacgacgtacgttaaggagtttacgtacgtttttacg

SEQ ID NO: 436577 - DNA, 660 bp, Homo sapiens
  misc_feature: GZ8MTXP02FHGM4.38.25.C03.1.454.CMB.2.raw
  modified_base (418)..(418): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacgacggccccgtggacgaagggtcttgaggtggagtgggatggatcagcaacttaacaaagtaggaaaacaacgaaaagtatacgacaactaattaaactttccgaagggtacagagtcagtacatagaaccanaagacaacactaccaagacgcaactcgaccctaacgaagttagggaaaccgtaggaaacgggtaaaccctggaacggtacttacgacggaaaccgaaccgtaaccggtaccctttaaataacgttttaagtaggttacggaccggtaaaggtaaacggtaaaacttaaaacctttcccttaaaccttaacctaaattaacgttaaacgaacgtacgtaggtaaaagtcgttactttttaacg

SEQ ID NO: 436578 - DNA, 602 bp, Homo sapiens
  misc_feature: GZ8MTXP02JR2FK.38.25.C03.1.454.CMB.2.raw
  modified_base (396)..(396): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagcagttatggtgtcagcgtgggtgcgacacggcccctggaccgaagggcttgaggtggagtgggatggatcagcaacttacaatggaaaacacaaagtatgacatataacttccgagggcagagtcagtcatgaccanagacacactaccaggactacacgtcgcctaacagtacgaacgtggaaacggtacctgagtacgtctaggaaccgacgtaacggtacctttaagtaatttagttcggttacggaccggaaagacgaaacttaaacgttccttaacccttaacaagttaacgttaaccggaacgtaagtacggtaaaaccgtttgtacctttttaacg

SEQ ID NO: 436579 - DNA, 631 bp, Homo sapiens
  misc_feature: GZ8MTXP02JHUHV.38.25.C03.1.454.CMB.2.raw
  modified_base (365)..(365): a, c, t, g, unknown or other
  modified_base (419)..(419): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagcgtgggtgcgacgacggccccgtaggacgaagggtcttggaggtggagtggggatggatctagctacttacaagtaggaaacacaaagtanacgacactataactttcgagggtacagtacgtacaatacaatcgaaacccgtanaacgtaacacaactacccaacgaacgactacgtacgacctaacagtacgaaacgtaggaacggtaaccctagacgtacgtagacgaccgaacgtaaccgggtactttaagtactttaagtcggttacgacggagtaacggtaaactaaactttcccttaaccttaactaaagtaacttaacgacgtacgtaggaagttcgttacttttaacg

SEQ ID NO: 436580 - DNA, 679 bp, Homo sapiens
  misc_feature: GZ8MTXP02GTFMS.38.25.C03.1.454.CMB.2.raw
  modified_base (378)..(378): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttatggtgtcaggtcgtgggtgcgacgacggtccccgtggacgaaggggtcttaggagtggagtgggatggatcgagactacttaacaagtacggaaaacaacgtaaaagttanacgacaacgtaattaaacgtttccgaaggggtacagggtactacaattaccgaagtacgaaacccaacgaacgaactaaaccactaccaacggacgaccaaccgtcgaacccttaacgagttacgggaaacgtacggaaacggaacctaggaacgtacgttacgaacgaacgaccgtacggttacctttaagttagtttaagttcggacgtacggtaagaacgtaactaaaccgtttcccttaacttaacgtattaacggttaaccgaacgtaacgtaggtaagttcgttactttttaacg

SEQ ID NO: 436581 - DNA, 654 bp, Homo sapiens
  misc_feature: GZ8MTXP02JIKIE.38.25.C03.1.454.CMB.2.raw
  modified_base (150)..(150): a, c, t, g, unknown or other
  modified_base (366)..(366): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcngcaacaggtgcccactcccaggttcaattggtgcagtctggagctgcggtgaagaggccgtggggcctcagtgaacgtctcctgcaaggcttctggttactacttttagctagttatggtgtcagcgtgggtgcgaacacggcccctaggacgaagggcttggagtggagtgggatggatcgagctacttaacaatacggaaaacacgaaaagtanacgactaataattaacgttacgaggcagacgtacatacatacgaacctaaacaacaactaacaactaccgaacgacgacacgtcgaacctaacgacgtacggtaaacgtacggaaacggaaccgtagaacgtacgtacgtaacggaaccgtaaccgtacggttaactttaagttaacgtttagttacggtacggaacgaagaaacgtaaaccgttaacctttaccctaaccttaactaacgttaacgtaacggtaacgtagtaacggtacgtttacgtttactttacg

SEQ ID NO: 436582 - DNA, 608 bp, Homo sapiens
  misc_feature: GZ8MTXP02H5CGI.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacgaagggtcttggaggtggagtgggatggatcgagcacttacaagtggaaaacacaaagtatcgacaacaataactttccgaaggggacaggagttacatcaagtcgaaccacaacgaccacactacccaacgacgacactacgacctaacgagtacggaactaggaaacggaaccgtagaacgactacgtacgaaaccgacgaccggtacctttaagtatttagtaggttgacgtaggaactaactaaactttccctacttaactaactaacgttacgaacgtacgtacggtaagttcgttactttacg

SEQ ID NO: 436583 - DNA, 653 bp, Homo sapiens
  misc_feature: GZ8MTXP02JGEOG.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaaggggcttgaggtggatgggatggactcgagctacgttacaagtacggaaaacctacaaaaggttatacgactaactaacttaacgttcgaggacaggtacgtactacgtaccgtaagtacgaaaccaacgaacaccaaccacgacccgaagacgaccaccgtcgtaccgtaaacgacgtacggtaaacgaggaaacgtaaccgtagtacgtacgtaccgacgaaccgaaccgtaaccgttacttaattacgttagtacggtacgtacgaacgtaaacgtaaacttaaacttaccttaccttaacttaactaacgttaacgtaacgtaacgtacgtaacgttacgttacgtttacg

SEQ ID NO: 436584 - DNA, 599 bp, Homo sapiens
  misc_feature: GZ8MTXP02GETSS.38.25.C03.1.454.CMB.2.raw
  modified_base (358)..(358): a, c, t, g, unknown or other
  modified_base (420)..(420): a, c, t, g, unknown or other
  modified_base (457)..(457): a, c, t, g, unknown or other
  modified_base (482)..(482): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgttggttacactttttagctagttagttgggtgtcagcgtgggtgcgacgacggcccctggacgaagggcttggagtggagtgggatggatcgagcacttacaataggaaaacanaaagtatcgacaactaattaacttccgaagggtacaggtacgtcaattcaatcgaaacctanacgaacaccactaccacgaacgacacctacgcctaanactaggaaactgaacggaacctganatcaacgacgacaccggtacttataagttatggtacgagtaagaagtaaaccttaatcccttaaccgttactaataacgtttaaccgacggtaactaggtaagtacgtacttttacg

SEQ ID NO: 436585 - DNA, 553 bp, Homo sapiens
  misc_feature: GZ8MTXP02FKNZZ.38.25.C03.1.454.CMB.2.raw
  modified_base (371)..(371): a, c, t, g, unknown or other
  modified_base (436)..(436): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggcttgagtggatgggatggatcagcatacaatggaaacacaaagtatagacgacataatttccgaagggcngagtcatcatagaccacagacacataccacgacgcactgacctacatggaaactggacggaaccngagactacgtagaacgtacacggtaccttagtaactttagttacgtgacgaaggaacgaactaaacgttcctacttacaattaacttacgaacgtactaggaacgtgtacttttacg

SEQ ID NO: 436586 - DNA, 642 bp, Homo sapiens
  misc_feature: GZ8MTXP02H3VKA.38.25.C03.1.454.CMB.2.raw
  modified_base (534)..(534): a, c, t, g, unknown or other
  modified_base (602)..(602): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggttgtcaggcgtgggtgcgacgacggccccgtggaccgaagggtcttaggaggtggagtgggagtaggatcgagactaacttaacgtaagtaggaaaacactaaaaggtactacgactaactaaacttaacgtttaccgaggggtaccaggtacgtacaacgtacaacgtcgaaaccaacgaaacgaaccaaccgtacacccgaacgacgactacccgtgacccctaagagtacgggaaactgggaaacgaacccgttgaaacgtnttacgagaccgacgtacgtactttatacgttgttagacgacgtagactaaacaactttcctacttaanacgtaacgtacgaacgagttagtacgttcttaacttttcg

SEQ ID NO: 436587 - DNA, 536 bp, Homo sapiens
  misc_feature: GZ8MTXP02GC34R.38.25.C03.1.454.CMB.2.raw
  modified_base (427)..(427): a, c, t, g, unknown or other
  modified_base (442)..(442): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggaccaagggcttgagtggagtgggatgggatcgagcacttacaataggaaacacaaaagtatacgacacataatttccaaggggtcacgagtcattaccagtacgaccacaagacacatccagagcactgcctanatgactgagactgantactagacgacacggacttatattatagtgacgagacgactaaacttccttactactataacgttaacgacgtataggtaagtcgtactttaac

SEQ ID NO: 436588 - DNA, 666 bp, Homo sapiens
  misc_feature: GZ8MTXP02ICKE4.38.25.C03.1.454.CMB.2.raw
  modified_base (538)..(538): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcaggagggcccaccgatcaactgacaagtccagccagagttgtttacacgaggtaccaaactaataacgtaattacttcgcttacggtaccaggacaacgaaaccaggaacacgtccctaccctaaagtttcgacctactaactttacgtgggtactacgtaccgttacccggggacggttccccggggtcccctaggaccgtacttccgaacgggccgacgacgggtccgggttacctgggacaaaccgtgttactttcacctctaccaccctaatccaacgcaaccgcctgacgaggtctaaggagtatgggtgtacctaagtttttattcgtgtaccganataagttattagttagttacgttaccgtacgtacgttacggtttacggggtaccggggtaaccggtaacggtaccgtacggttagaacgtaacgaaacgaaccgtaggtacggtcgtacgactaaccg

SEQ ID NO: 436589 - DNA, 782 bp, Homo sapiens
  misc_feature: GZ8MTXP02FZC0J.38.25.C03.1.454.CMB.2.raw
  modified_base (336)..(336): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcgagcgtgggtgcgacgacggcccctggacagggcttggagtggagtgggatggatcagcacttanaagtaggaaaacacaaagtatcgaccaacaattaactttccgaaggggcaggacgtacaattcgaattacggaacccaacgaaacgtaacaacctaactacccaacggaacgacccaaacgtcgaacccttaacgaaacgtacgggtaaaacccgtagggaaaccggggttaaaccctagggaaacggtaactttacccgtaacgggtaaaccccggaaaccggtaaccggggtttaaccctttaaaagtttaacgttttaaaacggtttgggttacggtaaacccgggaaaagggtaaaccgttaaaacccgttaaaaaccgtttttcccccgtttaaaacccccgtttaaactaaaacgttttaaaccgttaaaccgggtaaaccgttaaaacgggttacggggttaaaaacggtttcggtttaaacttttttttaaaacccgg

SEQ ID NO: 436590 - DNA, 547 bp, Homo sapiens
  misc_feature: GZ8MTXP02FFTO7.38.25.C03.1.454.CMB.2.raw
  modified_base (355)..(355): a, c, t, g, unknown or other
  modified_base (372)..(372): a, c, t, g, unknown or other
  modified_base (379)..(379): a, c, t, g, unknown or other
  modified_base (388)..(388): a, c, t, g, unknown or other
  modified_base (406)..(406): a, c, t, g, unknown or other
  modified_base (418)..(418): a, c, t, g, unknown or other
  modified_base (469)..(469): a, c, t, g, unknown or other
  modified_base (512)..(512): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttacacttttagctagttatggtgtcagctgggtgcgacaggcccctggacgaagggcttgaggtggagtgggatggatcagcactaacaagtaggaaacacaaagtangacacatattcgaggcngagcatnatagaccanagacacacgtacaggacncactcgacctanatggaaacctaggaacggacctgagactcgtacgacgacacggtccttaanagtttatacgtagcgaagacgtaactaaacttcctaacctaanacttaagtaacgacgtagagaacgtgtacttttag

SEQ ID NO: 436591 - DNA, 691 bp, Homo sapiens
  misc_feature: GZ8MTXP02GC25W.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggagtgggatggatcagcacttaacaagtaggaaaacacaaaagtatcgacaacgaattaaactttcccgaaggggcaggagtaccaattaccaatacggaaacccaacaaacgaaccaaaccactacccgaacgaacgaccaaccgttcggaacccctacgaacgttacgggaaaaccttcggaaacgggtaaacccttaggaacgtacgtaccgtacggaaccgaacgtaacccgggtacctttaagttactttaacgttggtacgaccggtaagaacggtaaacctaaaactttccccttaaccctttaacgtaactttaaacgtttaacccggaacgttaacggttaacggtaaaggtttacgttacttttttaaaccg

SEQ ID NO: 436592 - DNA, 636 bp, Homo sapiens
  misc_feature: GZ8MTXP02JI7FT.38.25.C03.1.454.CMB.2.raw
  modified_base (378)..(378): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaaggaggccgtggggcctcagtgaacgtctcctgcaaggcttcgtggttactacttttagctagttatggtgtcaggtcgtgggtgcgacgacggcccccgtaggacgaagggcttaggaggtggagtgggatggatcgagctacttaacgaaagtacggaaaacaacgaaagtanaccgacaactattaacgttaccgaagggacagtacgtacatacatacgaaccacagaacacactaccagacgacacgtcgacctaacagtacggaaactggtaaacgaacctagaacggtatacgtacggacgaaccgtaccggtacttaagttattagtacggtacgtaccggaaagtaactaaactaacgtttaccctaactaacctagttaaacgtaacgaggtaacgtaggtaaacttcggtttactttaacgg

SEQ ID NO: 436593 - DNA, 618 bp, Homo sapiens
  misc_feature: GZ8MTXP02JA0CF.38.25.C03.1.454.CMB.2.raw
  modified_base (382)..(382): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtggaacgtctccgtgcgaaggtcttcgtggttactacttttagactagttagtggtgtcgaggtcgtgggtgcgacgacggtccccgtaggaccgaagggtcttaggagtggagtgggatggatcgagtactacgtagaagtacggaaactacgaaagtnacgacataattaacgttcgaggcaggtactacatacgagtacgaccagaacgacaactacgaccgaacgacaccaccgtcgacctaacgacgtacggaaacgtacggaaacgtaacgtgaactcgtaccgacggaaccgacgtacgttaacttagtttaagtcgtacggtacgagaagaactaaactaccttctaactactataacgtacgagtagtagtagttactacgttttag

SEQ ID NO: 436594 - DNA, 636 bp, Homo sapiens
  misc_feature: GZ8MTXP02FNM08.38.25.C03.1.454.CMB.2.raw
  modified_base (365)..(365): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttatggtgtcgagtcgtgggtgcgacgacggcccctggacgaagggcttggaggtggagtgggatggatcgagcacttacaagtaggaaacacgaaaagtntacgacaacgtaattaagtttaccgaaggggacaggacgttacaattaccaatacggaacccacgaaacgaccaaccacgtacccaacgtaacgacctaacgtacgtacccttaagacgttacgggaaaacctcgggaaacgggtaaccctaggaacggtaacttcgtaacggaaccgacgtacgtacttagtactttagtgtacgacgaagacaactaactccttaactactaagtaacgttacgactagtacggattcgtacttttacg

SEQ ID NO: 436595 - DNA, 780 bp, Homo sapiens
  misc_feature: GZ8MTXP02ISCHU.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttatggtgtcagtcgtgggtgcgacgacggccccgtaggacgaagggcttggaggtggagtgggatgggatcgagactaacttacaaagtacggaaaacaacgaaaagtactacgacctaacgtaacttaaagttttaccccggaaggggtactaacggggtaacgtttaacccgaaattacccgtaaagttaccggaaacccccaaaacgaaacggaaaccctaaaccctaaaccgttaccccggaaaaccggtaaccggaaccctaacccgttccggtaaaccccttaaacgtaaacgtttacggggaaaacccgtttaacgggaaaccggggtaaaacccccgttagggaaacgtaaccgttccgtaaacggaacccgtaaccgtaaccgggttacctttaaagttaacgtttaacgttaggttacggacggtaaacgaaacggtaaaccttaaaacttcccttaactaactaacgtaacgtacgaacgtagtacgtacggtcttacttttag

SEQ ID NO: 436596 - DNA, 648 bp, Homo sapiens
  misc_feature: GZ8MTXP02GQFVR.38.25.C03.1.454.CMB.2.raw
  modified_base (327)..(327): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgacaagtccagccagagttgtttacacgacggtaccaacaaataagaattactcgcttagaccagacaagaaaccaggacacgcctacctaagttcgctactatttacgngggcacgtccgtaccgggtcgtcccggggtcctggtaccgtacttcgacggtccgacgtacggccgggttctggaacgacgtagtacgtttccacctctacccacactcgagcgacgtccctagccgaggtcgtaaggaagtagtggtcggtacttaggtttaattacgtagtacaagtacgtaagttaatttagtagttacgtacttacgtaacggttaccggtttcgggggaacccgggtaaactacggtacgttaagggaacgtaacgtaacggtaaaaccgtacggttacggtacggtactaccggacctaaacccg

SEQ ID NO: 436597 - DNA, 695 bp, Homo sapiens
  misc_feature: GZ8MTXP02IEVYM.38.25.C03.1.454.CMB.2.raw
  modified_base (367)..(367): a, c, t, g, unknown or other
  modified_base (421)..(421): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggctcagtgaacgtctcctgcaaggcttctggttactacttttagctagttatggttgtcagtcgtgggtcgcgacgacggcccctaggacgaagggcttggaggtggagtgggagtggatcgagcaacttacgaagtaggaaacacgaaagtanagacactattaactttaccgagggacaggagtcagtcatcgacacacgacacanaccgacgagcactacgacctaacgagacggaaacgtacggaaacggaaccgttagaacgtagtaccgtaggaacccgaccgtaaccgggttaccctttaaagtttacgttttaacgttacggtacggtacggtaacggaaacggttaaaaccgtaaacccgttttaccccgtttaaaaccgttttaacctaaccgtttaaaacgtttaaacccggaaaccggtttaacggtaaggggtttaaaacgggtttcgtttaacctttttttaaaccgg

SEQ ID NO: 436598 - DNA, 592 bp, Homo sapiens
  misc_feature: GZ8MTXP02FGHU4.38.25.C03.1.454.CMB.2.raw
  modified_base (383)..(383): a, c, t, g, unknown or other
  modified_base (401)..(401): a, c, t, g, unknown or other
  modified_base (431)..(431): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggtctggggcctcagtgaacgtctcctgcaaggcttctggttacacttttagctagttatggtgtcgagctggggtgcgacacgggcccctggacaaagggcttggagtggatgggatggatcagcacttaacaagtaggaaacaacaaagtatgacaacataatttccgagggcngacgtcatcatcgaccanacgacacactccaacgagcactcgacctanacgtggaaactggaaacggtaacctgaagtaagtcgtacgaaccgtaaccgtaaccggtaccttaaataacgtttagtgtacgacgtagaaacgaaaccttaaacttcccttacttaactataacgtacgaacgtagtggtaaaacgtcgtacttttaacg

SEQ ID NO: 436599 - DNA, 542 bp, Homo sapiens
  misc_feature: GZ8MTXP02JQJD6.38.25.C03.1.454.CMB.2.raw
  modified_base (376)..(376): a, c, t, g, unknown or other
  modified_base (379)..(379): a, c, t, g, unknown or other
  modified_base (384)..(384): a, c, t, g, unknown or other
  modified_base (389)..(389): a, c, t, g, unknown or other
  modified_base (417)..(417): a, c, t, g, unknown or other
  modified_base (484)..(484): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggccccagtgaacgtctcctgcaaggcttctggttacacttttagctagttatggtgtcagctggggtgcgacacggcccctggacgaagggcttgagtggatggggatggatcagcacttacaagtggaaacacaaagtatgaccacataattccgaggcagngtnatcangacanagacacactccagagcactcgacctaanatacggaactaggaacgaacctgaagactcgtaagaccgaacgacgtaccttaatactttaagttgngacgagacaactaaacttctactacattataacgacgatgtaagtctactttatttcg

SEQ ID NO: 436600 - DNA, 756 bp, Homo sapiens
  misc_feature: GZ8MTXP02G7WYZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcgagcgtgggtgcgacgacggccccgtggaccgaagggtccttaggaggttggagtgggagtggatcgagtctacttaacaagtaggaaaactactaaaaggtatacgacaacgtaattaaacgtttaccgaagggactaggtagttaccaagttaccgaagtaccggaaaccctaacgaaacgaaacctaaaccctaactacccgaaacgtaacgaccgaccttacggtaaccctaacgtaacgtacggtaaaaccgtacgggaaacggaacccttaaggacgtacttaccgaacgtaaccggaacccgtaacggttaaccctttaagttaacgtttagttacggttacggaacgggtaaagaaacggttaaaccttaaaaccgttttcccttaaaccgtttaaaccgttaaattaaaccgtttaaaacgggtaaacgtttaaaggtacggtttaaaacggtttcttaaacgtttttttaaccg

SEQ ID NO: 436601 - DNA, 689 bp, Homo sapiens
  misc_feature: GZ8MTXP02IO3W2.38.25.C03.1.454.CMB.2.raw
  modified_base (468)..(468): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagatgccgtgggcctcagtgaacgtctcctgcaaggcttcgtggttactacttttagctagttagtggtgtcgagcgtgggtcgcgacgacggccccgtaggacgaagggctttaggaggtagggagtaggggagttaggatcgaacgtactaacttaaaccgaaagtaaacgggaaaacaaacgtaaaagtactacgacctaaactaattaacgtttccggacgggtacgtaagtacgctaaattacgagtaccgaacccgaaanaacgaacactaaccgtacgaacgacgtaccacgtacgacctaagaacgtacgtaaacgtaacggaacgtaacgtagacgtaacgtcgtaacgaacgtaccgtaacgttaactttagttagttacgtcggagacggtaaactaaacgtaaacttaacccgttacccttactaacgtaacgttaacgtaacggtacgtaagtacgttaacgttacgtttaacg

SEQ ID NO: 436602 - DNA, 655 bp, Homo sapiens
  misc_feature: GZ8MTXP02IQUZN.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggaccaagggcttggagtggagtgggatggatcagcattacaatggaaaacacaaaagtatagacacataatttccaagggcagatcatcatcgaccacagacacataccagagacactacgacctaacagtacggaaacctagggaaacggaaacccgttggaagtacttacgtacgaacccggaaacgaaccggtacctttaagtaactttaagttaggttacggaccggtaaggtaaacgtaaaaccgtaaaaacgttttcccccttaaacccgtttaaacccttaagttaaaacctttaaacccgggaaaacttaacggtaacggggttaaaacgtttacggtttaaccttttttaaacg

SEQ ID NO: 436603 - DNA, 596 bp, Homo sapiens
  misc_feature: GZ8MTXP02GAE8H.38.25.C03.1.454.CMB.2.raw
  modified_base (351)..(351): a, c, t, g, unknown or other
  modified_base (364)..(364): a, c, t, g, unknown or other
  modified_base (370)..(370): a, c, t, g, unknown or other
  modified_base (423)..(423): a, c, t, g, unknown or other
  modified_base (426)..(426): a, c, t, g, unknown or other
  modified_base (470)..(470): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtactggagctgcggtgaagaggccgtggggcctcagtgaacggtctcctgcaaggcttctggttactacttttagctagttatggtgtcagcgtcggggtgacgacgacggccccgtaggacgaagggtctagaggtggagtggggattggatcgagctacttanaataggaaaccanaaagtntacgacacaataactttccgaaggggcaggactacaatacaatacgaaaccanaanacacaagaccgaacgataccactcggactaacagtcggaaaacnggaaaggaacctagacgtaatcgacaacggtacaccggttacttagtattagttggacgaggtagactaactaaacttccctaactctaaataataccgaacgtacgtgtaagtccttattttaac

SEQ ID NO: 436604 - DNA, 765 bp, Homo sapiens
  misc_feature: GZ8MTXP02H8FY1.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccacctcccaggttcaattggtgcagtctggagctgcggtgaagaggccgtggggcctcagtgaacgtctcctgcaaggcttcgtggttactactttagctagttagtggtgcgagtcgtgggtgacgacgacggcccctaggaccgagggtcttggaggtggagttgggatgggatcgaagtctaacgttaacgaagtaaggaaaacctaacgtaaaaggtataccgacaactaaattaacgtttaccgaaggggtacctaggtaacgttacaacgttacaacgtaccgaaaccaacaaacgaaccacgtaaccacccgaaacggaccgtaactaccgtacggtaaccctaaacgtacggttaaacggaaccggttaacgggtaaaccgggtaaaccgttaggaacgtacgttaccggtacggaaacccggtaacggttaaccggttacctttaagttaagttttaggttacggtacggtaacggaaacgttaaaccgtaaaaccttaaaccgttttaccctaaccgtttaactaacgtttaaaaccgttaaccgaaacggttacggttaggtttaaaacgtttcggtttaaactttttaccg

SEQ ID NO: 436605 - DNA, 654 bp, Homo sapiens
  misc_feature: GZ8MTXP02HUGWX.38.25.C03.1.454.CMB.2.raw
  modified_base (435)..(435): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacgttttagctagtttagtggtgtcaggtcgtgggtgcgacgacggcccctggaacgaaaggacttggagtggagtgggatgggatacaggactaacgttaacaaagtaggaaaacaacgaaaagtatagacaactaataaatttccgaagggacaggagttacaaataccaagtacgaccaaanaacgtaacaacacacaacgacgtacactacgacctacgaagtacggaaactaggaaacggtaacgtagaatactacgtacgaacgaaccgtacgtacgttaagttaagttaagttacgtacggtacgtaagtaaacgtaaacgtaaaccttaccttaaccttaactaacgttaacgttaacgtaacgtaacgtaaggtaacgttacgtttacgtttacg

SEQ ID NO: 436606 - DNA, 800 bp, Homo sapiens
  misc_feature: GZ8MTXP02GC7IH.38.25.C03.1.454.CMB.2.raw
  modified_base (406)..(406): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggtcttctggttactacttttagctaggtttagtgggttgtcgaggcgttggggtgcggacgacggtcccccgtaggaaccgaagggtcgtttaggaggtggaaggtggggattgggatcgaggtactaacgttaacgaagtacgggaaaacaacgaaaaggttanaccggacctaaacgtatttaaacgtttccggaacggggtcacgggtaacgttcaacgttaccgaagtaccggaaacctacgaagacctaaacactacccgaaggacacgaaccttacggaccttaagacgtaacggtaaaccgtacggaaacgtaaccgttaggaaccgtaacgttaccgaaacggaaccggtaaccggtaccggtttaaccctttaaagttaaacgtttaccgttttagggaccggtaaacgggtaaacgtaaaaccggttaaacccgttaaaccttttaccccgtttaaacccctttaagtaaacgttaaaccggtttaacccggaaaaccgtttacggggttaacggtaacggtttacggtttacctttttttaaaccggg

SEQ ID NO: 436607 - DNA, 643 bp, Homo sapiens
  misc_feature: GZ8MTXP02JAD97.38.25.C03.1.454.CMB.2.raw
  modified_base (422)..(422): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaataggaaacacaaaagtatgacaacataactttccgagggcagatcgatcatgaccacagacacactaccacgagacacctagaccctaanagtacggaaactggaaacggaaaccgttggaacgtacgttaccgaggaaccggaaccgtaaccgggttaacctttaagttaacgtttaacgtttaggtacggtaccggtaaaggtaacggtaaaccttaaaactttcccttaacccgtttaaccgtaaagtttaactttaaacccggaacgtaaacgttaggggtaaactttacggttacttttttaaacg

SEQ ID NO: 436608 - DNA, 746 bp, Homo sapiens
  misc_feature: GZ8MTXP02GSJ96.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcaggtcgtgggtgcgacgacggccccgtggaacgaagggtcttggagtggagtgggatggatcagactaacttaacgaagtacggaaaacaacgaaagtatacgacaactaataactttccgaagggacagacgtacatacatacgaaccaacgaacgaacaacactacccgaacgaacgactaacctacgtaaccctaacgtaacgtacggtaaaacgtacggaaaacggtaaccgtaggaacgtacgttacgaaccggtaaccgaaccggtaacggttaacctttaaagtttaacgtttaacggttaggtaccggaacggtaaaggtaaaccgttaaaaccttaaaaccgttttaccccttaaaccgtttaaaaccgttaaactttaaaaccggtttaaacccggtaaaacggttaaacgggttaacgggttaaaacgtttaccggttttaaaccgtttttttaaaccgg

SEQ ID NO: 436609 - DNA, 689 bp, Homo sapiens
  misc_feature: GZ8MTXP02FR0L0.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagtctagttatggtgtcagcgtgggtgcgacgacggccccgtggaacgaagggtcttaggaggtaggaggtgggagtaggatcgaggcctaacgttaacaagtagggaaaaccaacgaaaagtatacgacaactaattaaacgtttccgaaggggtacaggtacgtactaatacctaataacggaacctaacgaaagaaccaaccactaacccgaacggaacgaccaaccttacggaacccttacgaaacgttcgggaaaaccgtaggtaaaccggaaccgttagaacgtattccgaacgaacgaccgtacggttacctttagtaactttagtcggtacggagtaaacggaaactaacttaaacttaccccttactaactaataacgttaccggaagtacggttaaggtaacttcgtttactttttaaccgg

SEQ ID NO: 436610 - DNA, 742 bp, Homo sapiens
  misc_feature: GZ8MTXP02G7L1M.38.25.C03.1.454.CMB.2.raw
  modified_base (448)..(448): a, c, t, g, unknown or other
  modified_base (465)..(465): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtcgaacgtctcctgcaaggtcttcgtggttactacttttagctagttagttggtgtacagtcgtgggtgcgacgacggccccgtggacgaacgggtctggaggtggagtgggatggatcgagacctaacgttaacaagtaacggaaaacaagtaaaagtagtacgactaactaacttaacgtttaccgaaggggtacaggtagtaccaataccaagtacgaaccaanaaacgacaaccgtaacnccgaaacgacgacctacggtactaccctaagaacgtacggaaaaccgtaggaaaccggtaacccgttagggataccggttacgacggtaaaccggaccgttaaaccggtacctttaaagttaacgtttaagttaccggggagtaaccggaaagtaaacgttaaaaccgttaaaacctttccctttaaaacccgttaaacttaaaacgttaaccgtttaaaacggaaaccgttaacggttaaacggggtttaactttacgtttaactttttttacccg

SEQ ID NO: 436611 - DNA, 744 bp, Homo sapiens
  misc_feature: GZ8MTXP02J00Y0.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttatggtgtcagcgtggtgcgacgacggccccgtaggacgaagggtcttaggaggtggagtgggatggatcgagtcctaacttacgaagtaggaaaactaacgaaaagtatacgacactaattaacgttaccgagggtacaggtacgtactaactacgaataccgaaaccaacgaacgaaccaactaacgtacccgaacgacgacctaccgtaccgtaccttaacaaacgttacgggaaacctagggaaaccggtaacccgtaggtaaacgtacgttacgtaacggaaacccggtaaccgtaacccgggttacctttaaagtttagtttaacgtttaggtacggtaaacgtaaacggaaaccggttaaaaccttaaacgtttaccccctttaaaccgtttaaacctaacgtttaaacggttaaaacccgtaaggttaaccgtaagggttaacgtttaacggtttaccttttttaaaccgg

SEQ ID NO: 436612 - DNA, 634 bp, Homo sapiens
  misc_feature: GZ8MTXP02GXLBM.38.25.C03.1.454.CMB.2.raw
  modified_base (361)..(361): a, c, t, g, unknown or other
  modified_base (389)..(389): a, c, t, g, unknown or other
  modified_base (427)..(427): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacaagggcttgagtggagtgggatggatcgagcaacgttacaatacggaaaacaacaaaagttanacacaactaattaacgttaccgaggacngtatacatacatacgacacacgaacaacacaccacganacactacgacctaactagtacggaacgtaggaaacgtaacgtagaacgtactacgtacggaacgaaccgtaacgttacttaagttaacgttagttaggtacggtacgaaacgtaaacgtaaaccttaaaccgtttacccttaacttaactaaacttaacgttaaacggtaacggtaagtacggtaaacgtttacgttaacgttttag

SEQ ID NO: 436613 - DNA, 649 bp, Homo sapiens
  misc_feature: GZ8MTXP02JX1I8.38.25.C03.1.454.CMB.2.raw
  modified_base (205)..(205): a, c, t, g, unknown or other
  modified_base (358)..(358): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagnggcctggggcctcagtgaacgtctcctgcaaggcttctggttacacttttagctagttatggtgtcagcgtgggtgcgacgacggcccctggacaagggtcttggagtggagtgggatggatcgagctacttacaagtaggaaacacaaagtntcgaccaatattaaacttccgaggggacagggtactacacttaccatacgaaccacaacgaaccaaccaactaaccgaacgaacggacaccgtacgaccctaacacgttacgtaaacgtacgaacgggtaacccgtacgtagaacgttacgacgaaccgaaccgtaccggtaccttaagttactttaacgttcgttaggtacgaacggtaacgtaaacttaaacttaccttaccttaaccttaagttaacttaacgtaaccgtaacgtagtacgtaggttacgttttaacg

SEQ ID NO: 436614 - DNA, 675 bp, Homo sapiens
  misc_feature: GZ8MTXP02GN43C.38.25.C03.1.454.CMB.2.raw
  modified_base (287)..(287): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacncggccccgtggacgaagggtctggagtggagtgggatggatcgagctaacgttacaagtaggaaaacacgaaagtacacgactaactaattaacgtttaccgaaggggtacaggtaacgtactaattaccgaagtaccgaaccaaacgaacgaaccaaacactaccgaaacgagtaccaccgttacggaaccctaacgacgttacgggaaaactaggaaaccgggtaaaccgtggaaacgtacgttacgaacggaacgaaccgtaacggttacctttaagttacgtttaagtgttacggaacgtaagaaacgttaaactaaacgtttcccttaacttaactaagttaacgtaacggaacgtacgtaggtaacgtagtttacttttacg

SEQ ID NO: 436615 - DNA, 734 bp, Homo sapiens
  misc_feature: GZ8MTXP02HD3RI.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtaggttactacttttagctagttatggtgtcagcgtgggtgcgacgacggcccctaggacaagggtcttagaggtggagtgggatggatcgagtactaacttaacaagtacggaaaaacacgaaaagtataccgactaacgtaattaacgttaccggaggggactagggtacttacgaattaccaagttaccgaaaccaacgaaacaccaaactaccacccaaaggacacctaacccgtacgtaccctaaacgaacggttacggaaaccgttacggaaaccgggtaaaccgtaggaaacggttaccttaaccgtaccggaaacccggttaccgtaaaccgggttaccctttaaatttaagttttaacgttacggtaggaaccgtaaggaaacctaaacttaaaccgtttaccccttaacgttaactaaacgttaacggtaacccgtaaacggtacggttaaggaaccgtttgttaaaccctttttaacg

SEQ ID NO: 436616 - DNA, 630 bp, Homo sapiens
  misc_feature: GZ8MTXP02G6YER.38.25.C03.1.454.CMB.2.raw
  modified_base (360)..(360): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagtcgtgggtgcgacgacggcccctggacgagggtcttggaggtggagtgggatggatcagcacttacgaataggaaacacaaagtnacgacaactattaacgttccgaagggacaggtacgtacactacagtacgaaccaaacaacgaacaacctacacccgaaacgacgtaccaccgtacgtaccctaaacgagtacggaaacgtggaaaccggtaacctgaacggtcttacgacgaccgacgtacgtacttaatacgttataggtacgacggtaagaacgtaaacttaaactttccctaacttattaacgtaacgttaccgaacgtacgttaggtaagtttctactttttaacg

SEQ ID NO: 436617 - DNA, 724 bp, Homo sapiens
  misc_feature: GZ8MTXP02G9CGF.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggccccgtggaccgaagggcttggaggtggagtgggagtggatcgaagctaacttacgaagtacggaaaacacgaaaagtatacgaccaacgtaattaaacgtttacccgaaggggtacagggtaacgttcaaacgttacaatacggaaacccaaacgaacgaacctaaaccaacgtacccgaaacggaacgacctaaccgtacgtaccccttaaacgaaacgttacgggaaaaccgttacggaaaccgggtaaacccgtaggaaacgtacgttaccgtaacggaaaccgacccggtaaaccggttacctttaaagttaacgtttaagttacggttacgacggtaaagtaaacggtaaaccttaaaacgtttccctaaaccttacttaaactaacgttaacgaacgtagtaggtaacgtacgttactttttacg

SEQ ID NO: 436618 - DNA, 583 bp, Homo sapiens
  misc_feature: GZ8MTXP02I9F7C.38.25.C03.1.454.CMB.2.raw
  modified_base (363)..(363): a, c, t, g, unknown or other
  modified_base (371)..(371): a, c, t, g, unknown or other
  modified_base (404)..(404): a, c, t, g, unknown or other
  modified_base (414)..(414): a, c, t, g, unknown or other
  modified_base (435)..(435): a, c, t, g, unknown or other
  modified_base (448)..(448): a, c, t, g, unknown or other
tcagtcgatcacgtcacgaccggtgctcgatttagtagtgtagatttgggtttggggacccaaaaaccacacccctccttgggagaatcccctagatcacagctcctcaccatgggactggacctggagcatccttttcttggtggcagcagcaacaggtgcccactcccaggttcaattggtgcagtctggagctgcggtgaagaggcctggggcctcgagtgaacgtctcctgccaaggtcttctggttacacttttagctagttatggtgtcgagtcgtggggtcgcgacgacggcccctggacaagggcttggagtgagtgggatggatcagctaatacaagtaggaaactacaaagtntacgacanataacttccagggcagagtcatcatcgaaccanaagacatacncacggactcactagaccctanacgtaggaaaccnggaacgacgtagacgtacgtacgacgacgacgtacgtacttatatagtgtacgacgaacgtacgtaaactaacgttaccgtaacttaactaattaacgtaacgaacgtacgtacggtaacgttacgtactttacg

SEQ ID NO: 436619 - DNA, 529 bp, Homo sapiens
  misc_feature: GZ8MTXP02IVUBA.38.25.C03.1.454.CMB.2.raw
  modified_base (312)..(312): a, c, t, g, unknown or other
  modified_base (319)..(319): a, c, t, g, unknown or other
  modified_base (333)..(333): a, c, t, g, unknown or other
  modified_base (419)..(419): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgtttacacaggtaccaaacaaataaagaattaccttcgcttaggtaccagacaagaaaccaggacagcctactaagttgctnattacgnggcatctaccgggngtcccggggtcctgaccgacttcagcgcagcgggtctgagacagtattcactctcacatacagcacgcctgcagctagaagagtgngctagttattacgtgtacagcagtatatagtagtctactagtacgtttcgggaccgggtacacgcgtacggagacgtaacgaaaacgaacgtacgtgactacgacaaccg

SEQ ID NO: 436620 - DNA, 736 bp, Homo sapiens
  misc_feature: GZ8MTXP02I5C3G.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggcttcgtggttactacttttagctagttagtggtgtcaggtcgtgggtgcgacgacggccccgtggacgaggtcttggaggtggagtgggagtggatcgagctaacttacaagtacggaaacaacgtaaagtatacgactataacttaacgtttaccgaaggggacaggtacgtacgtaaatccgtaaagtacgaaacccaaacgaacgaaaccaaccgtaactacccggaaaccgagaccgtaaacctcggaaccctaaacgtacgtacggtaaaccggtaacggtaaaccggggtaaaccttacggaaagtacgttacgaaccggaaccgtaccggtaaccggttaactttaagttaagtttacgttagggtacggtaacggtaaacgaaacgtaaaaccttaacgtttaccccgttaaacgttaacttaaaacgtttaacgttaaccggaacggttaaggtaccgggtaaggtttactttaacggtttttaac

SEQ ID NO: 436621 - DNA, 752 bp, Homo sapiens
  misc_feature: GZ8MTXP02HFQDD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttagtggtgtcagcgtgggtgcgacgacggccccgtggaccgaagggtcttaggaggtggagtgggatggatcgagcacttaacgaagtacggaaaacaacgtaaaagtatacgactaacgtaaattaaacgtttaccgaaggggtaccaggtaacgttacaaacgttacaacgtacggaaacccaaacgaacgaaccaaacaacctaccgaaacggaacgacctaccgtacgaaccctaacgtacgtaacggtaaaccgtagggaaaccggaacccgttaggaacgtacgttaccgtaacggtaaccgaaccgtaacccggttacctttaaagtttaacgttttaaacgttaggtacggtaaaccgggtaaagtaaaccggtaaaaccgttaaaacgtttaccccttaaccgtttaacctaaatttaaacgtttaaacccggaacgttaacggttaaggtaacgtttacggtttaaccttttttaacg

SEQ ID NO: 436622 - DNA, 711 bp, Homo sapiens
  misc_feature: GZ8MTXP02JPFJC.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtcgtggagctgcggtgaaggaggccgtggggcctcagtgaacgtctcctgacgaaggtcttcgttggttactacttttagctagttagtggtgtcagcgtgggtgcgacgcggccccgtaggacgagggtcttggaggtggaggtgggacgtggatcgacgtctaacttaacgaaagtaggaaaacctaagtaaaacgtatacgactaacgtaacttaacgtttaccgaaggggtacagggtaacgtacaagtacaacgttacgaaaccaacgaacgaacctaaccaacgtacccgaaacgtaacgacctaccgtaaccgtaacccgttaacgaacggttaacggtaaaccgtacgggtaaaaccgtaaaccgtaggaacgtagtacgtaacggaccgtaacgtacggtacttaagttagttacgttgtacggagtagaacgtaaacttaaccgtttacccttaacttaacgtaaattaacgttacggaacgttacggtacgtaacggtttctacgtttttacg

SEQ ID NO: 436623 - DNA, 619 bp, Homo sapiens
  misc_feature: GZ8MTXP02F2CGK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgttcagcgtgggtgcgacaggcccctggacaaggcttgagtggatgggatggatcagcacttacaataggaaacacaaagtatagacacaattaactttcgagggactagagtaccatacgaagtcgaaaccacaacgaacaacgtacaccgaacgacgacaacgttcgaacccttaagaacgtacggtaaaccgtacggaaacggtaaacccgtagaacgtacgtacgtacgaacgacgacggtacttaagttattacgtgtacgtacgaagaacgtaaactaaacttacccttacttaactaattaacgtacgaacgtacgttacgggtaaattcgtacttttaacg

SEQ ID NO: 436624 - DNA, 695 bp, Homo sapiens
  misc_feature: GZ8MTXP02HAK4W.38.25.C03.1.454.CMB.2.raw
  modified_base (235)..(235): a, c, t, g, unknown or other
  modified_base (464)..(464): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcagtgaacgtctccngcaaggtcttcttggttactacttttagctagttatggtgtcaggtcgtgggtgcgacgacgggcccctggaccgaagggcttaggaggtggagtgggatggaatcgagctacgttacgaagtaggaaaaccagtaaagtatacgactaactaagttaacgttcgaaggggtacaggtagtcaatacactacgaaaccaacaagtacaacacgtaccacgacgactacncgtaacctagtacgtacgggtaaactaggtaaacggacccgttaggaacgtacgtttacgaaccgacggtaaccgtacgggttaccctttaaagttagtttaacgttcggtaacggtacggtaaagtaaccggtaaaactttaaacccgtttacccgttaccgtttaactaaaccgtttaagtaacccggtacggtaaacgttacgggtaaagtttcgtacgtttttaacg

SEQ ID NO: 436625 - DNA, 641 bp, Homo sapiens
  misc_feature: GZ8MTXP02G36H8.38.25.C03.1.454.CMB.2.raw
  modified_base (342)..(342): a, c, t, g, unknown or other
  modified_base (366)..(366): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttcgtggttactacttttagctagttatggtgtcagcgtgggtgcgacacggcccctggaccgagggtctagagtggagtgggatggatcgagctaacttanaagtacggaaaactacgaaaggtnacgacactaattaacgttcgagggcaggtagtacatacagtacgaaccacgaacgacaaccatacccgaagacgaccgtacctcggtaccctaacgacgttacggaaacctgggaaaccggtacctagagtactacgtacggaaaccgacgtacggtacctttaataagtttagtggtacgacggtagtaacgtaaccttaaactttcccttaacttaaccgtagttaacgtaaccggtacgaacgttaggtaaacgttcgttacgtttttaacg

SEQ ID NO: 436626 - DNA, 670 bp, Homo sapiens
  misc_feature: GZ8MTXP02GVRPB.38.25.C03.1.454.CMB.2.raw
  modified_base (661)..(661): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaaggaggccgtggggcctcagtgaacgtctcctgcgaaggtcttcgtggttactacgttttagctagttagtggtgtcgagcgtgggtgcgacacggcccctaggacgaagggcttggaggtggagtgggatggatcacggctaacttacgaaagttacggaaaaacaacgaaaaggttatacggaccaataattaaacgtttaccggaaaggacagtcgtacaacttacaataacgaaccaacaacgtaacaacgacacccaaacgacggaccctaacgtcgaacccctaagtaaccgtagggtaaaactcgggaaaacggtaacccgtggaacgtacgttacgaaccggaccgaacgtacgtaacctttaattaacgtttagtgtacgtacggaagtaaactaaacctaaacttaccctactaactaattaacgtacgacgtaataggattacgttnttttaaacg

SEQ ID NO: 436627 - DNA, 699 bp, Homo sapiens
  misc_feature: GZ8MTXP02F3VF4.38.25.C03.1.454.CMB.2.raw
  modified_base (289)..(289): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtcgcccactcccaggttcaattggtgcagtctggagctggcggtagaaggaggccgtggggcctcaggtgaacgtctctgcaggtcttcgtggttactatttagctagttagtggtgtcagcgtgggtcncgtacgaccggcccgtaggaccgaagggtcttaggaggtggagtgggagtggactgagtacctaaacttaacgaagtaaggaaaaccaaagtaaaagttactacgaacctaaataacgtttaaaccgtttaccggaaacggggtactagggtactactaacgttaaccgacgtaaacggaacccaaacggaaaccttaaccaaacctaaccgaccgaaacgaacgaccgtaaccgaccaaccgttaacgaacgttacggaaaccgtaacggaaaccgtaacgttgacgttacacgtacgaccgtacgtacgttaattataagtttgagacggaaacgagtaaacaaactttaccttctaacctaattaagtaaccgacggtatacggtaggtactttaggtcctttttaa

SEQ ID NO: 436628 - DNA, 635 bp, Homo sapiens
  misc_feature: GZ8MTXP02I5K35.38.25.C03.1.454.CMB.2.raw
  modified_base (563)..(563): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtagaagaggccgtggggcctgagtgaacgtctcctgcaaggtcttcgtggttactacttttagctagttatggtgtcgagtcgtgggtcgacgacgacggccccgtggaacgagggctaggaggtggagtgggatggatcagctaacgtaacaagtaggaaaacctagaaaagtatacgacaacgtaataaacttaccgaagggacagtacgtcaaacttacaagtacaaccaacaacgaaccaacaactaccgaacgagacaaccgtacgaacctacgagtacggtaaacacgggaaacgaacgtggaataccttagaaagaccgtaacgtacgtacttaagtagttagtagtcgaggtaanacgtaaactaaacttcctaaacctataaacttaagtaccgaagtaggttagaacgttcgttaacttttaacg

SEQ ID NO: 436629 - DNA, 585 bp, Homo sapiens
  misc_feature: GZ8MTXP02GWLG8.38.25.C03.1.454.CMB.2.raw
  modified_base (362)..(362): a, c, t, g, unknown or other
  modified_base (436)..(436): a, c, t, g, unknown or other
  modified_base (523)..(523): a, c, t, g, unknown or other
  modified_base (544)..(544): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggcttctggttactacttttagctagttatggtgtcagctgggtgcgacgacggcccctggacgaagggcttgagtggagtgggagtggatcgaggcaacgtttacaagtaggaaacaacaaagtanacgacaactataacttcgaagggcaggtatacgatacgatacgaaccgaacaagacaaccactaccgaacgganaccagttcgaccctaagatacggaaactcggaaagtaccctaggatacgtcaacgacgacgacgtacttagtactagtgcgacgtanacgtaactaacttcaccttanaacgttgtaaccgagtagtacggtagttacgtacttttacg

SEQ ID NO: 436630 - DNA, 608 bp, Homo sapiens
  misc_feature: GZ8MTXP02F3GQP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgaggtggatgggatggatcgagcaacttacaagtacggaaaacacaaaagtatcgacaacaattaaactttccgaagggtcaggagtacatcatgaaaccacaacgacaacgatacccacgagacactgaccctacataggaaactgaacggaacctgaagatctacgaccgaacgtacggtaccttagttactttagttggtacgtacggagaacggtaaactaaaactttcccttaccttaactaacgttaaacgtttaacggacgtaacgttagggaaacgtttggttactttttaaacg

SEQ ID NO: 436631 - DNA, 650 bp, Homo sapiens
  misc_feature: GZ8MTXP02JK4M2.38.25.C03.1.454.CMB.2.raw
  modified_base (354)..(354): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaaggaggccgtggggcctcgagtgaacgtctcctgacgaaggtcttcgttggttactacttttagctagttagtggtgtcgagtcgtggtgcgacgacggcccgtggacgaggtcttggaggtggaggtgggagtggatcgagactactaanaaagaggaaaacaagaaaagtatacgacaacgtaacttaacgttccgaaggacagtacgtacaaactacaagtacaaacccaagaacgaaccacacgtaccgaagacgacaccgtacgaccctaaacgagtaacggaaacgtaggaaacgtaacgtagatacgtacgacgaaccggtaacgacgttactttaagttattagtacggtcgaacgtaggaactaaaccgttaaactttccgtaaacttacgtaattaacgtacgtaacgtaggtaagttacgttacttactttttacg

SEQ ID NO: 436632 - DNA, 695 bp, Homo sapiens
  misc_feature: GZ8MTXP02JSF42.38.25.C03.1.454.CMB.2.raw
  modified_base (387)..(387): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagacggccgtggggcctcagtgaacgtctccgtgcaaggtcttctggttactacttttagctagttatggtgtcagtcgtgggtgcgacgacggcccctaggaccgaagggtcttaggaggtggagttggggagtggactcgacggtacctaacttaacgaagtacggaaaaactacgtaaagtntacgactaacgattaacgttccgaagggcaggactacattacaatacgaacccagaacgaaccaactacgacccgaagacgtcgaaccgtctaacccgtaagtacgaacggtaaacgtaggaaaccggtaacccgttggaaacgtacgttaccgtaacggaacccgtaaacggtacccggttaacctttaattaaagttcgttaggacggtacgaaagaaccgtaaaccttaacttaccccttaacgtaactaacgttaagtaaacccgtacgtaacgttaggtactttacggttacctttttaaacg

SEQ ID NO: 436633 - DNA, 704 bp, Homo sapiens
  misc_feature: GZ8MTXP02GMOOD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaggtcttcgtggttactactttagctagttagtggtgtcagtcgtgggtgcgacgacggtcccgtggacgaagggtcttaggaggtggaggtgggagtggatcgagtctacttaacaagtacggaaaacaacgtaaagtatacgacaactaattaaacgttccgaaggggtacagggtacgtactaacgtaccaagtacgaaaccgaacgaacgaaaccaactaaccacccgaacggacgtaccaccgttacacccgtaaagacgtaacgaaacggtacggtaaacggaaccttagggaactacgtacgtaacggaaccgtaaccgtacggttaacctttagtttaagtttagtaggtacgtaacggaaaggtaacgtaaaccttaaacctttaccctaaccgttaataaacgttaaacgttaaccggaacggttaaggtacggtaacgtttcggtttaactttttaacg

SEQ ID NO: 436634 - DNA, 603 bp, Homo sapiens
  misc_feature: GZ8MTXP02JX549.38.25.C03.1.454.CMB.2.raw
  modified_base (317)..(317): a, c, t, g, unknown or other
  modified_base (409)..(409): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctactgcaaggcttctggttacacttttagctagttatggtgtcagctgggtgcgacaggcccctggacaagggcttgagtggatgggntggatcagcattacaatggaaaacacaaagtatcgacagaataatttccgaaggggcagagtacagtacaatcgaaacacaacgacaatacnccacgagcaactcgacctaactagtacgaaacgtgaaacggaacctgaacgtagtcgtacgaaaccgtaccgtaacggtacctttagtaactttactaggtagacgtaaggaagtaaacctaaacttacccgtaccttaataagttaagttaaaccgaacgtacgttaacggaacgttagtacgtttttaaacc

SEQ ID NO: 436635 - DNA, 675 bp, Homo sapiens
  misc_feature: GZ8MTXP02FGRT3.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtgggcctcagtgaacgtctcctgcaaggcttcgtggttactacttttagctagttagtggtgtcgagcgtgggtgcggacgacgggccccgtggaacgaagggtcttaggaggttggaggtgggtagtggagtacgacgactaacgttaacgaaagtaacggaaaacaacgtaaaagtagtacgactaactaaagtttaacgtttaccggaaggggacaggagtacatacaagtacgaaaccaaacaacgaacacactaccgaacgaacgacaaccttcgaccctaacgtacgtaacgggtaaacgtaggaaacggtaaccgtaggaacgtactacgtacggaaccgtaccgtaacggttaccttaagttattaggttacgtacggacgtaaaggaactaaacttaaacttaccttacctaactaattaacgtaacgtaagtagtagtaagtctacttttaacg

SEQ ID NO: 436636 - DNA, 630 bp, Homo sapiens
  misc_feature: GZ8MTXP02H6DK3.38.25.C03.1.454.CMB.2.raw
  modified_base (430)..(430): a, c, t, g, unknown or other
  modified_base (448)..(448): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcaggtcgtggggtgcggacgacgggccccgtaggaacgaagggtcttggaggtggagtgggagtggatcgagctaacgttaacaagtaggaaaacaacgtaaaagtatacgacaactaattaaactttcgaagggcaggagtacatcatgaaccanacgacacacgtacacgancgactcgactaacagtaggaacgtaggaacgaccgtagagtacttacgacgaacgacgtaccggtacctttaattaagtttacgtggtacggagtaaacgacgtaaaacttaaacctttccaaccttacgttaaactaagtaaccgtaaagtacggttaggtacgttagttacgtttttaac

SEQ ID NO: 436637 - DNA, 671 bp, Homo sapiens
  misc_feature: GZ8MTXP02FPNBK.38.25.C03.1.454.CMB.2.raw
  modified_base (357)..(357): a, c, t, g, unknown or other
  modified_base (418)..(418): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggaccgaaggggcttggaggtggagtgggatggatcgagcaacttacaagtaggaaaacanaaagtatacgacaactaataaactttccgaaggggacaggacgtcaatcaatacgaccaanaacgaacaacaactacccacgaacgacactcgaccctacaagtacggaaactacggaacggaaacccttaggaacgtacgtacgtaacgaacgaaccgtaaccggtacctttaaattaagtttaagttaggtacggaccgtaaaggtaaacggtaaaaccttaaaactttaccccttaaaccctttaactaaacttaacgtttaaacggaacgttaaacggtacgggtaaacggttacggttactttttaacg

SEQ ID NO: 436638 - DNA, 766 bp, Homo sapiens
  misc_feature: GZ8MTXP02H7NF5.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttcgtaggttactacttttagctagttagtggttgtcaggtcgtgggtcgacgacgacggccccgtggaccgagggtcgttggagtggagtgggatgggatcgagtacctaacgtttaacgaaagtaagggaaaaccaacgtaaaagtactacgaccaaactaaacgttaacgtttacccggaaaggggtactaggtacgtacctaacgtacgaataccggaaccaacgaacgaacaacactaccgaacgacgtaccacctcgaaccctaaccgtagtaaccggaacgttacgggaaaccggtaacccgttaggaacgtaacgtaccgttacggaaaccgtaccggttaacccgggttaaccttttaagttaaccgttttaggttaccgttacggacgttaaacggaaaccgttaaaactaaaacccttttccccggtaaaccgttttaaacaaccgtttaaaacgttaccggtaaaacggttaaccgttaagggggtaaacctttcggttttaaacgtttttaaccg

SEQ ID NO: 436639 - DNA, 667 bp, Homo sapiens
  misc_feature: GZ8MTXP02JXC8D.38.25.C03.1.454.CMB.2.raw
  modified_base (383)..(383): a, c, t, g, unknown or other
  modified_base (622)..(622): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactactttagctagttagtggtgtcgagcgtgggtgcgacgacggtccccgtaggacgaagggtcttaggaggtggagtggggatgggatcgagtactacttaacgaagtacggaaaacaacgtaaaagttanaccgacaagtaacttaacgttccgaagggacagtagtactagtactagacgaaccaacgaacgaaccaaacacgtaccgaacgaacgacctaacgtacgtaccctaagtaacgtacggtaaacgtaggaaacggtaaccgtaggaactacgttacgacgaaccggtactaccggtactttaagtaatttagtacggtacgaacggaaagaccgtaaaaccttaacttcctaaccttaanaataacgtaacgaacgtagtacggtatttacggtactttttaacg

SEQ ID NO: 436640 - DNA, 646 bp, Homo sapiens
  misc_feature: GZ8MTXP02HUE2D.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttacactttttagctagttatggtgtcagcgtgggtgcgacacggcccctggacgaagggcttggagtggagtggatggatcagcacttacaagtaggaaaacacaaagtatacgacaactataacgtttcgaagggcagagttacatccaatacgaccacgagtaacacactaccgagacgcactcgacctacgagtacggaaactaggaacggtaaccgtggaacgtagttaccgagacccgaacgtaccggtaacctttaagttaacgtttaagttggtacggtacggtaaacggtaaacgtaaacgttaaactttccccttaactttaaactaacgttaacgtttaaacggaccgttaagtagggttaaacgtttcggtttaacctttttaacg

SEQ ID NO: 436641 - DNA, 797 bp, Homo sapiens
  misc_feature: GZ8MTXP02FTWP0.38.25.C03.1.454.CMB.2.raw
  modified_base (375)..(375): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttacacttttagctagttatggtgtcagctgggtgcgacgacggcccctggaccaagggcttggagttggatggggatggatacgagacctaacttacgaaagttacggaaaaacacgtaaaaggttanacgaccctaagtaattaacgttttcccggaaggggacctagggacttacaattaccaatacggaaacccaacgaacgaccaaaccgttaacaccccgaagggacgaaccctaaccgttcggaaaccccttaacgaaacggttacggaaaacccgttagggaaacccggtaaaacccgttaggaaaccgttaacgtttacccgaaacggaacccggtaaacccgtaaccgggttaacccttttaaaagttaccgtttaaacggttcggggttaaacgaacggtaaaacggttaaacgttaaaaccctttaaacccttttaccccgtttaaaaccttaaaccgttaaacgtttaaaccggttaaaaccggtaaacggttaaacggttaacggtttaaacgtttaccgttttacgtttttaaacg

SEQ ID NO: 436642 - DNA, 721 bp, Homo sapiens
  misc_feature: GZ8MTXP02GQNBV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttagtggtgtcagtcgtggggtgcgacgcggcccctggaccgagggtcttaggaggtggagtggagtggatcgagctaacgttaacgaagtacggaaaacaacgtaaaagtacgtacgacaactaagttaacgtttacccggaagggtacaggtacgtactaacgtaccgtaagtacgaaacccaacgaaacgacctaaaccacgtaaccccgaacggaccgtacgaacccgtacgaacccgttaacgaggtaccgggtaaaaccgttacggaaaccggttaaaccgtaggaagtaccgttaccgaacggtaaccgaaccgtaaccggtactttaagtactttagtcggtacgacgtaaacgaacgttaaacctaaactttacccgtaacctttaactaaacgttaacgttaaccggaacgtaaggttaacggtaaggtttcgtttacctttttaacg

SEQ ID NO: 436643 - DNA, 769 bp, Homo sapiens
  misc_feature: GZ8MTXP02ILDH3.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggtcttcgtggttactacttttagctagttagtggtgtcagtcgtgggtgcgacgacggccccgtaggacgaagggtcttggaggttggagtgggatggaactcgaagctaacgtttaacgaaagtacggaaaaacacaaaaggtctaccgactacgtaaattaacgttccgaagggtaccaggtacgttacaagttacaacgtacgaaaccaagaacgacaaccgtacacccgaacgacgtaccaaccgttcgaacccttaaagacgtacggtaaactacgggaaaaccggtaacccgttagggaactacgttacccggaacggaaacccgtaaaccggtacggtttaacctttaaatttaacgttttaggttacgggttaacgggtaaaccggaaaggtaaaccggttaaaaccttaaaacccgttttccccgttaaaacccgtttaactaaaacggtttaaacttaaccccgggtaaaagttaggttaaaaccggggtaacgttttacggttacgtttttttaaaccg

SEQ ID NO: 436644 - DNA, 749 bp, Homo sapiens
  misc_feature: GZ8MTXP02GZAFX.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgccgtacggggacatcgtgatcgacccagtcctccagacctcccgtggctgtgtctcgtgggcgaggacggccaccatacaactgacaagtccagccagtagttagtttacacgtacggtaccaaacaataagtattactcgacttaggtaccagacaagaaaccaggaacacgtacctacctaaaggttcactactaactttacggtcgggactacgttacccggtaccccgggtacggtccccggggttcctacggtaaccgtaccgttaccgacggtaccgggaccgtacgggtccgggttactggaacgaacgtacgttacgtttaccaacttcctaccaaacctacaacacgacctacgcccgtagacgacgtacgtaagtaacgtagttcggtaacggttacgtttaaaggtttacttacgttacggtaccgtaaacgtacgtttaagtttaaagtttaacgtttaagttaccgttaccgttaccgttaaaacgggtttaccgggtttaccgggggaacccgggtaaacgtaacgggtcgttaaacggacgttaaacgaaaccgtaaaacgtcggttcgaccggttacaccggtacttaaaccgg

SEQ ID NO: 436645 - DNA, 700 bp, Homo sapiens
  misc_feature: GZ8MTXP02JCZVQ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagtcgtgggtcgcgacgacggccccgtaggacgaagggtcgttaggaggtgggagtgggagtggactcgagactacgttaacaagtacggaaactaacgaaaagtatacgacaactaagttaacgtttccggaagggtacgaggtacgttactaactacgtaacgtacgaaacccaacgaacgtaacaacctaccgtaacccgaacgaacgacctacgttaccgaccttaacgagtacgtaaacgtacgaacggtaacccgtagaacgttataccggtacgaaccgaacgtaccggtaactttaattacgtttaagtgtcggtaacggaaggtaaacgtacttaaaacccgtttccttaactaactacgtttaaacgttaaccggtaggtaaggttacggtaacgtttacgtttaactttttaacg

SEQ ID NO: 436646 - DNA, 645 bp, Homo sapiens
  misc_feature: GZ8MTXP02I6Z08.38.25.C03.1.454.CMB.2.raw
  modified_base (437)..(437): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtgggcctcgagtgaacgtctcctgcaaggtcttcgtggttactacttttagctagttagtggtgtcagtcgtgggtgcgacgacggccccgtaggaacgaagggtcttaggaggtggagtgggagtggatcgagactaacttaacgaaagtaggaaaacaacgtaaaagtatacgacaataattaaacgttccgaaggacaggtactacaatacaatacgaaccaanaacgaacaacacaccgaacgacgacacacgacctaacacgtacgaacgtacgaacgaacgtagagacgtacgtacgacgacgaccggtacttaattagttacccccgttagtacggtacgaagtaacgtaaactaaacttacccttaccttaacgttaacttaaacgtaacgtaacgtaacgtaggtaacgttacgttacttttaacg

SEQ ID NO: 436647 - DNA, 700 bp, Homo sapiens
  misc_feature: GZ8MTXP02G3D4L.38.25.C03.1.454.CMB.2.raw
  modified_base (446)..(446): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggccgtggggcctcagtgaacgtctccgtgcaacggtcttctaggttactacttttagctagttatggtgtcagtcgtgggtgacgacgacggcccctaggaaccgaaggggcttaggagtggagtggggatggatcgagctaacttaacaagtaacggaaaacaacgaaaagtatcgacaactaagttaacggttcgggatagagtcataccgatacgaaccaagaactaacacaaacncccgaaacgacgaccaactcgaacctaacgaagtacgaaacctagggaaacgaaaccgtggaaacgtacttacggaacgaaccggtaaccgtacggtaacctttaaagttatttaagttggtacgtaacgggtaaaacgaaacgttaaaaccttaaaaccgttaccttaaacccgttaaagtaaaacgtttaacgtaaacggtaacgttaaggttaacgggttaattacggtttaacgtttttaacgtttacgg

SEQ ID NO: 436648 - DNA, 676 bp, Homo sapiens
  misc_feature: GZ8MTXP02IYF92.38.25.C03.1.454.CMB.2.raw
  modified_base (404)..(404): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagctgggtgcgacaggcccctggacaagggcttgagtggagtggggatggatcgagcaacgttacaataggaaacacaaagtatcgacacattaatttccagacagagtcatcatacgacacagacacacnccagagccaactcgacctaacgagtacggaaacctaggaaacgggtaaacccttggaacggtaacttaccgtacggaaaccgtaacgaaccgggttaccctttaaattaaagtttagttttaacgggtacggtaaccggtaaaggtaaacgttaaaacctttaaaacccgtttacccgttaaaacccttaaacttaaaacgtttaaaccgttaaaacccggttaaacggtaaacggttaaaggggtaacgtttacgtttaacctttttaacg

SEQ ID NO: 436649 - DNA, 897 bp, Homo sapiens
  misc_feature: GZ8MTXP02HE2XV.38.25.C03.1.454.CMB.2.raw
  modified_base (344)..(344): a, c, t, g, unknown or other
  modified_base (385)..(385): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaaggaggccgtggggcctcgagtgaacgtctcgtgacgaaggtcttcgttggttaacttacgttttagctagttagtggtgtcagtcgtgggtcgcgacgacggtcccctggacgaaggtctggaggtgagttgggatggancgagactacgttaaacaagtacgaaaacaacgtaaaagtanacgactaactagttaaacgttaccgaggtaccagggtacgtactaaacttacgaacgttacggaaacctaacggaaacaaacccgaaaccttaaacccgtaccccgaaaacggggaacccgtttaactaaaccccgtttacgggtaaacccctaaacccgaaagggttaaaccggaaaacccgtttaagggaaaaccgggtaaaccccgttaacgggaaagtacggtaaacccgttaccggggaaacccgtaaaccggtaaccccggtttaaccctttaaacgttaaacgtttttaacgggttttagggtaaccggaaacccgggggttaaagtaaaaacccgtttaaaacccgtttaaaaaccccgtttaccccgttttaaaccctttaaaaaccggttaaaccgtttaaaacgtttaaaaacccccggggttaaacggttaaaacgggggtttaaaaccggtttacggtttaaaaaccccgggtttttatttttttttaaaacccccggg

SEQ ID NO: 436650 - DNA, 744 bp, Homo sapiens
  misc_feature: GZ8MTXP02J1B0S.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgagccccgtggacgaaggtctggagtggagtggagtggatcagctaacgttaacaagtaggaaaacaacaaaacggtatagacctaactaagttaaacgtttaccgaggggtacaggtacgtaccctaagtcaagttacggaaacccaacgaacgaaccgaaacaactaccgaacgacgtacgtaacctacggacccttaaaccgaagtacgggaaacgttacggaacgggtaacgtacgggagtaacgttaccgtacggaccggtaaacgtaccgggttacctttaaagttagtttacgttaacggtacggtaacccggaaaaggttaacgtaaaacccgttaaaaccgttttcccctaaaacccgtttaaccggtaaaactttaaccgtttaaaaaccggtaaccggttaaacggttaacggggttaaacggttacgtttaaacgttttttaccgg

SEQ ID NO: 436651 - DNA, 627 bp, Homo sapiens
  misc_feature: GZ8MTXP02F19IP.38.25.C03.1.454.CMB.2.raw
  modified_base (407)..(407): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacaagggcttgagtggatgggatggatcgagcacttacaagtaggaaacacgaaaagtatcgacacaataaactttccgaaggggctaggacgtcaatcaatacgaaccanaacgacaacactaccacgacgacactacgaccctacagttaggaaacctggaaacggaacctagaaggtattcgacgaaccgtaccgaacggttacccttaagtactttaagttcggtacgaccggaaagaacgtaaacctaaaactttccccttaaccgttaacctaagtaacgtttaacggaaccggtaagtacgggtaaacgttgtactttttaacg

SEQ ID NO: 436652 - DNA, 598 bp, Homo sapiens
  misc_feature: GZ8MTXP02HR5NY.38.25.C03.1.454.CMB.2.raw
  modified_base (218)..(218): a, c, t, g, unknown or other
  modified_base (334)..(334): a, c, t, g, unknown or other
  modified_base (337)..(337): a, c, t, g, unknown or other
  modified_base (346)..(346): a, c, t, g, unknown or other
  modified_base (349)..(349): a, c, t, g, unknown or other
  modified_base (363)..(363): a, c, t, g, unknown or other
  modified_base (392)..(392): a, c, t, g, unknown or other
  modified_base (394)..(394): a, c, t, g, unknown or other
  modified_base (396)..(396): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctnagtgaacgtctcctgacaaggtcttctggttaactacttttagctagttatggtagtcagctgggtagcgacgaggcccctggaacgaagggcttaggagtggagtggatggactnagnacgttaaanaanagaaacagaaatanacgacatataacgtacgagacagatacanananacgacaacaacaacaacacacgacgacgacacacactaacgagtacgaacgacggaacgtaacgtagagtacgtacgtacgaacgaacgtacgtacttagttagttaagtagtacgacgaagaacgtaaactaaacttaccttacttaactaacgttaacgtaacgtaacgtaacgtaacgtaacgttacgttacgtttacg

SEQ ID NO: 436653 - DNA, 675 bp, Homo sapiens
  misc_feature: GZ8MTXP02I8VQV.38.25.C03.1.454.CMB.2.raw
  modified_base (337)..(337): a, c, t, g, unknown or other
  modified_base (374)..(374): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgacgtctcctgcaaggtcttctggttactacttttagcgtagttagtggtgtcgagtcgtgggtgcgacgacggccccgtggacgaagggtcttggaggtggagtgggatggatnagactaacttacgaagtacgaaaacacgtaaaggtancgacaacgtaattaacgttccgaaggggtacaggtacgtacaatacgtacgtacgaaaccacgaacgaacacacgtaccacggacgaccaacgtcgaaccctagtaacgtacggtaaacgtacggaaacggtacccgtagacgtacgttcgaacgaaccgtacgtaccggttactttaattagtttagttacggtacgacggtaagtaacgtaaaaccttaaacgtttcccgtaacctttaagtaaccttaagttaaccggaacgtaggttaacgtacgtttacggtttactttttaacgg

SEQ ID NO: 436654 - DNA, 707 bp, Homo sapiens
  misc_feature: GZ8MTXP02JP1X9.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtggaagaggccgtggggcctcgagtgaacgtctcctgcaaggtcttcgtggttactacttttagctagttagtggtgtcgaggcgtgggtgacgacgacggccccgtggaacgaagggtcttggaggtggtaggtagggatgggaatcgagtactaaacgttaacgaagttacggaaaactaacgtaaaagtatacgaccaactaaattaaacgttcgaagggtacaggtactacaatcaataccgaacacaagacaacctacacccgaagacactaccgcgaactaacgagtaacgaaaccgtggaaacgtacgtagacgtaacgtcgaaacggaccgtaccgtaacggtactttaataccgtttgttaacggtcgaaccggggaaattaccggtaaaactttaacccgtttaccccgttaaactttaaaacccgtaacgtttaaaacggtaaaccgtaacggttaaaggttaaggtaaaccgttttggtttaaccttttttaacgg

SEQ ID NO: 436655 - DNA, 776 bp, Homo sapiens
  misc_feature: GZ8MTXP02HT4VQ.38.25.C03.1.454.CMB.2.raw
  modified_base (293)..(293): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttctggttactacgttttagctagttagtggtgtcagtcgtgggtgcgacncggcccctggacagggtctgaggtggagtgggatggatcagctacttacgaagtaggaaaacacgtaaaagtatcgactaacgtaattaactttccggaagggtacaggtactacatacacgtacgaaaccacgaacgtacaaccatacccgaacgacgtacctaccgtacgtaacccttaacgaaacgttaacgggaaaccgttagggaaaccggtaaacccgttaggaaacgtaaccgttaacggtaacggaaacccggtaaaccgtaacccgggttttaaccgtttaaaactttaagttttaccgggttacggttaacggaaaacccggggtttaaaggaaaacctaaaacccggttttaaaaccttttaccccccgtaaactttaaacccgtaatttaaaacccgggtttaaccggaaaaccgtttaaacggtaagggggtttaaaaccctttgggttttaaaccccgtttttttaacg

SEQ ID NO: 436656 - DNA, 683 bp, Homo sapiens
  misc_feature: GZ8MTXP02IEO1R.38.25.C03.1.454.CMB.2.raw
  modified_base (377)..(377): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtcgcccactcccaggttcaattggtgcagtctggagctgcggtgagaggcctggggcctcagtgaacgtctcctgcaggtcttcgtggttactacttttagctagtttatggtgtcagtcgtgggtgcgacgacggtcccctaggaccgaagggtcttggagtggagtgggatggatcgagactacttacgaagttacggaaaactacgtaaagttacncgacctaacgtaagtttaacgtttcccggaaggggtcctagggtacgttaccaaattacccgaagttaccggaaacccaacgtaaaccgaacaacccgttaacgtacccccaaagggaccgttaaccaccgttacgaacccccttaagacggtacggaaacgttacggaaacgggtaacccttagggactaacgttcgacggaacgtacctacggtactttaatatttacgtgagtacgaaggactaaactaaacttcctacttataataacgttaacgactagtaggtaacttgtacttttaacg

SEQ ID NO: 436657 - DNA, 706 bp, Homo sapiens
  misc_feature: GZ8MTXP02G0RAI.38.25.C03.1.454.CMB.2.raw
  modified_base (219)..(219): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctnagtgacgtctcctgcaggtcttcgtagttactacgttttagctagttagtggtgtcagcgtgggtcgcgacgacggccccgtaggacgaagggtcttaggagtggagtggggactgggaactcgagtactaacgttaacgaacgtaggaaaacctaacgtaaaaggttataaccggtaccaaactttaaagtttaaacgtttacccggaaggggacctaggtaaacgtctaaacgtctaagtaccggaaaccacgaaacgaacccaactaacgaccccaagggaaccactacgtcacccttaagagtacgggaaactcgggaaacaaaccggttgaacgtagtacctaggaacccgaacgtaccggttaacttaaggttacttagttaggtacgacgtaacggtaaactaaaccgttaaacctttaccctaagtaaacttaacgtaagttaccggattaacggtagtacgttacctttgttttaacg

SEQ ID NO: 436658 - DNA, 588 bp, Homo sapiens
  misc_feature: GZ8MTXP02JOHKQ.38.25.C03.1.454.CMB.2.raw
  modified_base (424)..(424): a, c, t, g, unknown or other
  modified_base (435)..(435): a, c, t, g, unknown or other
  modified_base (555)..(555): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggcctcagtgacgtctctgcaggtcttctggttactacttttagctagttagtggtgtacagcgtggggtgacgacacggcccccgtaggacgaaggggtcttaggaggttggagtgggatcggatcgagctaacttacgaagtacggaaaacaactaaaggtatacgactaatattaaacttcgaaggcaggactcgaatcatcgaacctanacgacacaacnccgacgagactaacgcgaaccctagacgaggaaacgtcgaaggaacctagacgtagtacacgacgacacggtcttaagttacttagtcgtagacgagtaacgaactaacttcctacttanacgtaatacgacgagtacgaattcgtactttac

SEQ ID NO: 436659 - DNA, 652 bp, Homo sapiens
  misc_feature: GZ8MTXP02FGFM9.38.25.C03.1.454.CMB.2.raw
  modified_base (476)..(476): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcgagcgtgggtgcgacacgggcccctggacgaaggggtcttggaggtggagtgggatggatacgagtactacttaacaagtaggaaacaacaaaggtatacgactaacaattaaacgtttccgaacgggacagtacgtactattaccatacgaaccgaacaaacgaacaacgaactaccgaacgacgaccaacgttcgaccctanaacgttacggaaactaggaaacgaaccgtaggaacgtagtacgtacggaaaccgtacgtaaccggtaccttaataagtttagtgtacgacggaagtaacgaaacttaaaccttcccttaacctataacgttaagttaaccgacggtaaacgtaggtaaacgttcgtactttttaag

SEQ ID NO: 436660 - DNA, 820 bp, Homo sapiens
  misc_feature: GZ8MTXP02H0T86.38.25.C03.1.454.CMB.2.raw
  modified_base (503)..(503): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggctttctggttacctactttagctagttatggttgtcacgtcgtgggtcgcggaccgacgggccccctgggaaccgtaaaggggtccttagggaggtagggtaggttggggagttacgggatccgaaggtacctaaacgtttaaccaagttaacgggaaaacaaacgtaaaaggttatcggaacctaactaactttaaacgtttaccgaaggggtccagggtacgttacaacgttctaacgttacgacccaaacaacgacaaacncttaccgagtacgaaacgtactacgtaccgtaacccgtacgtaacgtaacggtaaaccgtacggtaaacggggtaaacctagggtaaagttacgtaccggttaacgaacgggtaaccggtaaccggtttaccctttaaattaagtttaaaaccgttggttaacgggtaaccgggaaacgttaaaaccgggtaaacctttaaaacccgtttaccccgtttaaacccgtttaacgttaaaaacctttaccgttaaaacccggtaaacggttaaacgggtttaaacccggggttaaacgttttaacgtttttaaacccgg

SEQ ID NO: 436661 - DNA, 626 bp, Homo sapiens
  misc_feature: GZ8MTXP02H4FRK.38.25.C03.1.454.CMB.2.raw
  modified_base (371)..(371): a, c, t, g, unknown or other
  modified_base (444)..(444): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccacttcccaggttcaattggtgcagtctggagctgcggtgaagaggccgtggggcctcagtgaacgtctcctgcaaggcttctggttactacttttagctagttagtggtgttcaggtctggggtgcgacacggcccccgtaggaccgaaggggctttggagtggagtgggatggatcagctattacaatcggaaaacacgaaaagtangaacaagtaattaaacgtttccaaggggcagtagtacattcaatacgaaccacaagacacactaccgaacganaccacgttacgactaaaccagtagggaaacctggtaaacggaaaccctggaatactacgtacgacgaccacggttactttagtaatttagtgtacggaggtaaggtaacaaactaaactttcctacctttaaacgacttaaagtaaccgaacgtagtaaggtaattcggttaactttttacg

SEQ ID NO: 436662 - DNA, 805 bp, Homo sapiens
  misc_feature: GZ8MTXP02ILV4E.38.25.C03.1.454.CMB.2.raw
  modified_base (387)..(387): a, c, t, g, unknown or other
tcagtcgatcacgtcacgaccggtgctcgatttagtagtgtagatttggttttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagcgtgggtgcgacgacggcccctggaacgaagggtcttggaggttggagttgggatgggactcgagtcctaacgtttaacgaagtacgggaaaaactacgtaaaaaggttntacgaaccctaataatttaaacgtttacccggaaggggtaccagggtacgtacaaagttaccaacgttcgggaaacccctaagaaacgaccaaaccgttaaactaccccgaaacggaacgacctaaccgtaccgtaacccttaaacgaaacgttcgggaaaaccttagggaaaacgggtaaccccttagggaagtaaccgtttaccgtaaccgggtaaccgaaccggtaaccccggttacttttaaatttaagtttaaaagttccgggggttaaacgaaaaccgggtaaacgtaaacgttaaaacccttaaaacccgtttaccccgtttaaaccgtttaaaacgtaaacgtttaaaaccggttaaacggaacggttaacggttaagggttaacgttttacggtttaacgtttttaacg

SEQ ID NO: 436663 - DNA, 680 bp, Homo sapiens
  misc_feature: GZ8MTXP02HWPUN.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagtagcaacaggtgccccactccctaggttcaattggtgcagtctggagctgcggtgaagaggccgtggggcctcagtgaacgtctcctgcaaggtccttctggttactacttttagctagttatggtgtcagcgtggtgcgacgacggcccctggacgagggtctggagtggaagtgggagtggatcgagactacttaacaagtaggaaacaacgaaagtatagaccaactaattaacgtttaccggaggtacgacggtagttactactactacgtacgaacccaacgaccgacaacaactacccgaacgacgcctaacctaccgtacctaacgacgttacgaaacgtggaaacgggtaaacctaggaacgtattaccgacggaaaccgacgtaccggttacgttaaatttacgtttagtagtacgtaacggagtaaacgttaaactaaaccgtttacccttaacttaactacgttaacgttaaccggtacgtaagttacgggtacgttacgtttacgtttacgttttaccg

SEQ ID NO: 436664 - DNA, 661 bp, Homo sapiens
  misc_feature: GZ8MTXP02GI9I1.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtcgtgggtgcgacgacggcccctggacagggtcttggagtggagtgggatggatcagctaacttaacaagtaggaaaaccagtaaagtatacgacaacgtaattaacgttaccgagggacaggtactacattacagtacgaccaacgaacgaccaaacactacccgaaacgacgaccaaccgtcgaccctaaagtacgtaacgggtaaacgtacggaaacggtaaaccccgttagggaaactacgttaccgtaacggaaacccggtaccgttaacggtacctttaattagtttacgtggtacggacgtaagtaacgtaaactaactttaccctaactactaacgtaagttaaccggacgtacgtaggtatacgttactttttaacg

SEQ ID NO: 436665 - DNA, 622 bp, Homo sapiens
  misc_feature: GZ8MTXP02GGH3O.38.25.C03.1.454.CMB.2.raw
  modified_base (234)..(234): a, c, t, g, unknown or other
  modified_base (437)..(437): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagtagtntttacacaggtaccaaacaataaagtaattacttcgacttcggtaccagacaagaaaccagacagcctacctaagttgactctattactgggctatccgacccgggtacgtccgggtcctacgaccgtactcgacgtcggcacggcggtacgtgagacagtacttcgactctcactatcagcacgctgacgaagctagaaagngtagtcggtacttagtttagttaactcgtacaacgtactaaggttaacttaaggtagtacgttaccgtacgtaacggttacgggttttaccgggggaaccgggggtaacctaaacgggtccgttaagggacgttaaaagaacccgtaaaaacgtcggttaaggcggtacgtcggaccctaaaccg

SEQ ID NO: 436666 - DNA, 704 bp, Homo sapiens
  misc_feature: GZ8MTXP02GUY5O.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcgtggggcctcagtgaacgtctcctgcaaggtcttcgtggttactacttttagctagttatggtgtcagtcgtgggtgcgacgacggcccctaggacgaagggtcttggaggtggagtgggatggatcgagactaacttaacgaagtaggaaaacacgtaaaagtatacgactaactaattaactttaccgaagggacaggtaagtacaattaccaatacgaaaccaacgaacgaaccaacaactacccgaacgaacgaccaacttacggacccttaaacgagttacgggaaaacctagggaaacgaaacccgttgaaagtacgttacgtacgaaccgtaaccggtaaacggttacccttaaattacgtttaagttacggtacgaacggtaaaggttaacggaaaacctttaaaacctttccctaaaacccgtttactaaacttaacgtttaaaacgaccggtaaagtacggttaaagtacgtttacttttaaacg

SEQ ID NO: 436667 - DNA, 728 bp, Homo sapiens
  misc_feature: GZ8MTXP02G7AHR.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagtctgggtgcgacgaggcccctggaccaagggtcttgagtcgagtcggatggatcaggtcaacttacaagtacggaaaactacgaaaaggtataccgactactaattaactttccgaaagggacaggtacgttactaaacgttccaagttaacggaccctaaacaaacgtaacaaactaactacccgaacggacgacttacctacggaccctaaagacgttacgggaaaacttcgggaaaaccggtaccttaagacgtacgtaacgtagaacccgaaccgtaacggtaccctttaattaacgttacgttagttacggtacgaaaacgggtaacgtaaaacttaaaaccgttccgtttaaacccctttaaaacgttaaatttaaaacccgggtttaaacccaaaacggtaacgtaaaggggtaaaaccggtttcggttaaactttttttaaacgg

SEQ ID NO: 436668 - DNA, 700 bp, Homo sapiens
  misc_feature: GZ8MTXP02JTQR9.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcgaaggtcttcgtggttactacttttagctagttagtggtgtcaggtcgtgggtgcgacgacggtccccgtggacgaagggtcttggaggtggagtgggagtggatcgagctacttacaaagtacggaaaacacgaaagtagtacgacactaattaacgttccgaagggacaggtacgtacagtacagtacgaaccaacaacgaaccaacacacccgaacggacacctaacctacgaacccttaacgacgtacggtaaacgtacgggaaacggtaaccgtaggaaacgtcggttaacgacggaaccgtaaccggtaaccggttaacctttaagttaacgtttacggttaggttaccggaaacggtaacgtaaacgtaaaccgttaaacctttaccccgttaaccttaaacgtaacttaacgtaaacgtaaccgtaacgttacggtaaagttcgtttaacttttacg

SEQ ID NO: 436669 - DNA, 640 bp, Homo sapiens
  misc_feature: GZ8MTXP02JT0KA.38.25.C03.1.454.CMB.2.raw
  modified_base (402)..(402): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcaggtcgtggggtgcgacgacggccccgtggaccgaagggtcttggaggtggagtgggatggatcgagctaacttacgaataggaaaacaacgtaaaggtatacgacaactattaaactttccgaaggcngaacgtcaactcaattacggaccaaacaacgaacaaacactacccgaacgagacgtactcgacctaaccgagtacgacgtaggaacggtaaccgtgaagtgtacgtaagaccgaacgacggtaccttaaagttagtttagtacggttgaaccggtaagtaacggtaaacttaaacttaccttacctactaacttaacgtaccgtaaacgtacgtacggtagtttacgtctttttaacg

SEQ ID NO: 436670 - DNA, 614 bp, Homo sapiens
  misc_feature: GZ8MTXP02GQ421.38.25.C03.1.454.CMB.2.raw
  modified_base (273)..(273): a, c, t, g, unknown or other
  modified_base (286)..(286): a, c, t, g, unknown or other
  modified_base (417)..(417): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggtcttctggttactacttttagctagttatggtntcagcgtgggtcncgacgcggcccctggacgaagggcttggagtggagtgggatggatcgaagcaacttaacgaagttacggaaaacacaaaagtatcgacaataattaattccgaagggacaggatcgaatacagtacaccanaacgactacacaccaacgacgacactacgacctaacagttacggaaacttacgaacggaacctagacgtacgtacgtacgaacgacgacgttacttattagtttagtcggtagacgtaagacgtaaactaaacctttcctaaccttaataataacgttaaccgaacgtacgtaggtaacggttacttatttttaacg

SEQ ID NO: 436671 - DNA, 790 bp, Homo sapiens
  misc_feature: GZ8MTXP02JP71D.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctcctgcaaggcttctggttactactttagctagttagtggtgtcagcgtggtgcgacgacggccctaggacgagggcttggaggtggagtgggagtggactcgaggtacctaacgtttaacaaaggtacggtaaaaaccaaacgtaaaaggtactacgacctaacgtaaattaaacgtttaccggaaggggacaggtaacgtagaacttacgacgttacgaaaccacaaacgaacaccaacgtaccaacgtacgactacgtcgacctactacgtaacggaaacgtaggaaacggaaccgttagaacgtacgtaccgtaacgaaacccgtaaccggtaaccggttaccgtttaaatttaaaccgtttaaggttacggttaacggaaccggggtaaaacggtaaaaccttaaaaaccgtttaaaacccggttttaccccgtttaaaccctttaaacccgttaaaagtttaaacccggttaaaacccgggttaaaccggtttaaaaacgggttaaaggggtttaaaccggttttaccggtttaaaccttttttttaaaccgg

SEQ ID NO: 436672 - DNA, 621 bp, Homo sapiens
  misc_feature: GZ8MTXP02IPBQ7.38.25.C03.1.454.CMB.2.raw
  modified_base (341)..(341): a, c, t, g, unknown or other
  modified_base (362)..(362): a, c, t, g, unknown or other
  modified_base (441)..(441): a, c, t, g, unknown or other
  modified_base (561)..(561): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcgaaggtcttcgtggttactacttttagcagttagtggtgtcagtcgtgggtgcgacacggcccctggacgaaggcttgaggtgagtgggatggatcagctaacttanaagtaggaaacacgaaaagtntacgacataataacgttacgaaggtaagagtacaatacgaactacggaacaacaacgaacctaataccaaccgaaacgngtaaccctacggtctacccttaagaagttacgggaacttagggaaaaccgggtacctaaggacgtactacggaacgaccgtacgacggttacttaaagttattagttgccgaagacgaanaacttaaactcctacctaatactactaacgatagtacggtaatcgtttacttagttttcg

SEQ ID NO: 436673 - DNA, 692 bp, Homo sapiens
  misc_feature: GZ8MTXP02GN5IX.38.25.C03.1.454.CMB.2.raw
  modified_base (678)..(678): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcagcgtgggtgcgacacggcccctggacgaagggtcttgaggtggagtgggatggatcgagctacttaacaagtaggaaaacaacgaaaagtatacgacaactaactaaactttaccgagggtacaggtagttacaattacaagtacggaaccaacgaacgaaccaaccaactacccgaaacgacgacctaacctacggtaaccccttaacgaaacgtacggggtaaaaccgttacgggaaacggtaacccgttagggaactacgttaccgtaacggaaccgaaccgtaccgggtaacctttaataacgtttaagttcggtaggtacgtaaaggtacgtaaaaccttaacttccctaaccttaacgtaacttaacgttaaccgaacgtaggtaacgtaacggttnttaactttttacgg

SEQ ID NO: 436674 - DNA, 724 bp, Homo sapiens
  misc_feature: GZ8MTXP02I72TZ.38.25.C03.1.454.CMB.2.raw
  modified_base (285)..(285): a, c, t, g, unknown or other
  modified_base (466)..(466): a, c, t, g, unknown or other
tcagtcgatcacgtcacgaccggtgctcgatttagtagtgtagatttggggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctccgtgcaaggtcttcttggttacacttttagctagttagtggtcgtcagctgggncgacgaggcccctggacgagggtcttggagtggagtgggagtggatcgaggctaacgttataaagtaggaaaacataaaaggtactacgacaaactaagttaactttccgaagggaccgaggtacgttacgacttcaagttcgaaacccacaaacgtacaaccaacgtacccgaacggaanaccctacgtactacccgttaacaagtacggtaaacgttacggaaacggtaaccgttaacggagtaactccgtaacgaaccggtaaccgtaccgggtttaaaccctttaagtttaacgttaaacgggttgtaacgggtacgtaaacggaaaccggtaaacccttaaaacgttttcccccttaaccggttaaacttaacgttaacgtttaaacccggtaacgttaggtaaacggttacgtacggttttactttttaaacg

SEQ ID NO: 436675 - DNA, 725 bp, Homo sapiens
  misc_feature: GZ8MTXP02GIEUX.38.25.C03.1.454.CMB.2.raw
  modified_base (342)..(342): a, c, t, g, unknown or other
  modified_base (354)..(354): a, c, t, g, unknown or other
  modified_base (373)..(373): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgagacggccgtggggcctcagtgaacgtctcctgctaaggcttcgttaggttactacttttagctagttatggtgtcgaggtcgtgggtcgacgacacgggcccctaggacgaaggtcttggaggtggagtggagtggancagctaacttanaagtagaaaacacaaagtnacgacctaataacttacgtttaccgagggtacaggtactctaataccaggtaacaccgaaacgaacgaaccaactaccaaccgacggactacccaccggtacgtaacccttacgaagttacgggaaaccttaggaaaccgggtaacctagggaactacgttacggaacgtaaaccgaacgacccggtttaactttaaacgttaaagtttcggttaagttggaaaccggaaagtaaacggttaaacccttaaactttaccccgtttaacgtaaaccttaaaagttaaaccggtttaaccggaacggttaaacggtttacggggtaaaactttcggtttaacttttttaaccgg

SEQ ID NO: 436676 - DNA, 630 bp, Homo sapiens
  misc_feature: GZ8MTXP02ICXH2.38.25.C03.1.454.CMB.2.raw
  modified_base (318)..(318): a, c, t, g, unknown or other
  modified_base (381)..(381): a, c, t, g, unknown or other
  modified_base (395)..(395): a, c, t, g, unknown or other
  modified_base (411)..(411): a, c, t, g, unknown or other
  modified_base (436)..(436): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtggggcgaggacgggccaccatcaactgcaagtccagccagagttgtttacacgaggtaccaaactaaataagtaatttactcgcttaggaccagcaagaaaccaggacacgcctacctaaggttcnctactatttacgtgggactacgtccggtacccggggtaggtcccggggtccctacgaccggtntcgacggtcggacnggtcggtctggacganacggtactttcactctacaccctancacgtcacgccgtagcgaggacgtaggagtagttcggtaggtacttagtttacgttacgtgtacgtagtacgttagttattagttacgtacgttacgtacgttaacggttacgggttacggggaccggtaacgtacggtacgtacggtaacgaacgtaacgtaacgtacgtcggtacgtaccgtacgacctacg

SEQ ID NO: 436677 - DNA, 649 bp, Homo sapiens
  misc_feature: GZ8MTXP02I6ORU.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttcgtggttactacttttagctagttatggtgtcagtcgtgggtgcgacacggcccctaggaccgaagggtcttggagtggagtgggatggatcgagctacttacgaagttaggaaaactacgaaaagttatacggacctaagtaacttaaacgttttccgaaggggacaggtaacgttacaagttacgatacgaaaccacgaaacgaccaacaactacccgaacgagacctacctacgaaccctaactagtacggtaaactacggtaaacggaacccgttagaacgtacgtactacgaaccgtacgacggttaccttattattagttgtaggacgtaagacgtaaactaaacgtttcctactaacctataacgttacgacgtagtacgtagttacgttacttttaacg

SEQ ID NO: 436678 - DNA, 613 bp, Homo sapiens
  misc_feature: GZ8MTXP02FLB9C.38.25.C03.1.454.CMB.2.raw
  modified_base (445)..(445): a, c, t, g, unknown or other
  modified_base (549)..(549): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtgacagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacagggcccctggacagggcttgagtggagtgggatggatcagactactaacaagtaggaaacacaaagtatacgacacgaattaaacgtttccgaagggtcaggacgttacattaccaagtcgaaacccaacgaagaacaaccatacccgaaacggacnccaacctcgaccctaacgacgtacggaaaactggaaacggaccgtagacgtaactagacgaacggaccacggtaccttaagtatttatacggttagacggtaanaacgtaaactaacttacctactaagtaactaacgtacgaacgtagtacgtagttcgtactttag

SEQ ID NO: 436679 - DNA, 705 bp, Homo sapiens
  misc_feature: GZ8MTXP02HAOH6.38.25.C03.1.454.CMB.2.raw
  modified_base (369)..(369): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggtcttctggttactacttttagctagttatggtgtcagctgggtgcgtacgacggcccctaggacgaaggggtcttggagtggacgtgggatggatcgaagcaacttagaatacgggaaaacacgtaaagtanaccgactaactaattaacttccgaaggggtacagtaacgctaacttaccgatacggaaccaacgaacgaacaacactacccgacgacgactaccgtcgtaaccctaactacgtaacggaaacttacggaaacggaacccgtagaaagggtaccttaacggacgtaacccgaaacggacccggttaacttaatttaacgtttacgaggtttacgaaccggaaggtaaacgtaaaccgttaaaaccgtttcccttaacccttaaagttaaactaaaacgtttaacccggaaagttaaaccggttaaaggtaaccggtttagttacctttttaaaaccg

SEQ ID NO: 436680 - DNA, 703 bp, Homo sapiens
  misc_feature: GZ8MTXP02IW0KK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttagtggtgtcgagtcgtggtgcgacgacggccccgtaggacgaagggtccgttggaggtggaggtgggagtggatcgagctaactttacaagtaaggaaaacaacgtaaaagtactacgacaaacgtaattaaacgtttacccgaagggtacgaacgggtacgttaacgaacttaccgaacgttacggaaaccctaacgaaacgtaaacccaactaaaccgtacccgaaacggtacgacctaaccgttacgacccttaacgagttacggaaacgttacgggaagtaaacccgtgaaacgtaccgtacgtaacgacctaccggtacggtacctttattaacgttagtaggttacgacgtaagacttaaaactaacttcctaactaaccgtacgttaacgttacgaaacgtagtacggtaacgttactttacttttaacg

SEQ ID NO: 436681 - DNA, 695 bp, Homo sapiens
  misc_feature: GZ8MTXP02GOM9R.38.25.C03.1.454.CMB.2.raw
  modified_base (452)..(452): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaaggaggccgtggggcctcagtgaaccgtctcctgcgaaggtcttctggttactacttttagctagttagtggtgtctgcgtgggtgacgaacgtcggcccctaggacgaagggcttggaggttggagtgggagtggtatccgaggtcctaacgtaacaagttaacggaaactaacgaaaagtctagaaccataattaaacgttcgaggggtacaggacttcattacagtacgacacaaacgaccaaacnctaacccgaagacgacacttccgaaccttagaagtacggaacttacggacgtaaaccctggactaacgtctaacggaacccgtaaccgtacggtaacctttataaccgtttagttacggttagaaccgggaagtaaaccggtaaaacttaaaaccggttttcccttaaccggttaaacgttaacttaacgttaaccgtaaacggtaggtaaccgggttacttagggtttaccttttttaacgg

SEQ ID NO: 436682 - DNA, 613 bp, Homo sapiens
  misc_feature: GZ8MTXP02JCJ79.38.25.C03.1.454.CMB.2.raw
  modified_base (482)..(482): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtacgacacggcccctggacgaagggcttgagtggatggggatggatcgagcacttacgaataggaaacacaaagtatagaccacagttaacttaccgaggacagcgtacagtcagtacgaaccacgaacgaacacactaccaacgagactactccactacgagtacgaacgacgaaacggacctaggacgtactacggtanacccggaacgtaccggtacctttatacgtttagtagtcggaccggtaagaacgaacttaaaacgtcccttaacttaacctagtaacttaacggacgtaacgttaggaagtttcgtactttttatttaccgg

SEQ ID NO: 436683 - DNA, 633 bp, Homo sapiens
  misc_feature: GZ8MTXP02GMGR7.38.25.C03.1.454.CMB.2.raw
  modified_base (480)..(480): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtggggtgcgacgacgggccccctagggaaccgaaaggggtcttggaggtggagttgggatggatcgagcaactttacaaagtacggaaaacaacgaaaagtactagacaaactaattaaacgtttccgaaggggtcagggtacttacaattaccaatacgaaaccacgaacacaactaacaccaagacgacactagaccctaanacgttacggaaactaggaaacggaacctgaacgatcgaacgacgtaacgaaccggtcttaagttattaagtcgtagacgaagaacgaacttaaaacttcccttaactactaaataacgtacgtaacgtacgtaagtagtactttagtttaacc

SEQ ID NO: 436684 - DNA, 704 bp, Homo sapiens
  misc_feature: GZ8MTXP02JJB7G.38.25.C03.1.454.CMB.2.raw
  modified_base (336)..(336): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagtagttgtttacacaggtaccaacaataaagaattacttcgctttaggaccagacaacgaaaccgaggacacgcccttacctaaagtttcgactactattttacgnggggacctacgtccggtaacccgggacggttccccggggtcctcggaacccgtacttccgacggcggacgcgggtacgggtctggaacgtacgtacgtactttccaccttacctaccaaccctattaccgaacgcacggcccgtagcccgagggttacgtaggaagtattagggtccggtacgttaaggtttttaactaccgttggttacaaaccgggttacgttaagtttaacgtttagttaacggttacgtaccgttacggttaacggtttaccgggttaccgggggaaccggggtaaacgtaacgggtacgtaacggacgtaacgtaaaccgaaacgtacgtcggtaccgtacgacgtacctacg

SEQ ID NO: 436685 - DNA, 678 bp, Homo sapiens
  misc_feature: GZ8MTXP02H1UOV.38.25.C03.1.454.CMB.2.raw
  modified_base (394)..(394): a, c, t, g, unknown or other
  modified_base (414)..(414): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactactttttagctagttatggttgtcagcgtgggtcgcgacgacggcccctaggacaagggcttggaggtggatgggatggatcgagctaacttaacaagtaggaaaacacgaaaagtatacgacaactattaacttcgaggacnggactcatcgatcgaaccanacgactaacacacccgaacgataccaccgtcgacccctaaacgtagacggtaaacgtacggaaacggtaaacccgttggaaagtacgttaccgtacggtaaaccgaaccggtaaccgggttaacctttaagttaacgtttaacgtttcggtacggaccggttaaaggaaacggttaaaccttaaaactttccccgtaacttttaaaccaatttaacgttaaccgtaagtacgtaaaggggttacttacggtttactttttaacg

SEQ ID NO: 436686 - DNA, 786 bp, Homo sapiens
  misc_feature: GZ8MTXP02F8GY8.38.25.C03.1.454.CMB.2.raw
  modified_base (284)..(284): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttatggtgtcaggctgggtncgtacacggccccgtggacgaagggcttaggagtggagtgggatggatacgacgtctaaccgttagaaagttacggaaaactaacgtaaaagtataccggaaccaacgtaaacttaaacgtttacccggaaggggtactacggtacggtactaaggttaccaacgttacgaaacccgtaaacgtaaacgaccttaaaccgaacctaacccggaaaccggttaacggaaccctaaccgtacggtaacccccttaaagaacgggtttaaacggaaaaccgttagggaaaccggtaaacccgtaaggtaaccgtacgtttaccgtaaccggaaaccggtaaccgggtaaacccggttacctttaaaggttaaccgtttagtttacggaacggttacggaaacgtaaacgggtaaacccttaaaccttcccccgttaaattaaccgttaacgttaacgtaacggtaacgttacggtaaggtacttaacggtttacctttttaacgg

SEQ ID NO: 436687 - DNA, 664 bp, Homo sapiens
  misc_feature: GZ8MTXP02IAQXJ.38.25.C03.1.454.CMB.2.raw
  modified_base (495)..(495): a, c, t, g, unknown or other
  modified_base (521)..(521): a, c, t, g, unknown or other
  modified_base (608)..(608): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgagaggcctggggcctcgagtgaacgtctcctgcaaggcttctggttactacttttagctagttatggtgtcagcgtgggtcgcgacgacggcccctggacgaaggcttggagtggagtggatggatacgagctaaacttaacgaaagtacggaaaacaacgtaaaagtagtacgaactaacctaatttaacgttccgaaggggcctaggactacacttacgaatacgaaccgaacaaacgaccaacgtaacacccgaacggaacacacgttcgacctaacgaagtcggaaacncggtaaacggactagggataccggtnaacggaacgtacgacggttactttaataagtttgtacggtaggaacgtaaacgtaaacttaactaaaactttccctaacctttaaanaacgttaaacttacggaaacgttagtaacggggtaacttttacgtttacgtttacg

SEQ ID NO: 436688 - DNA, 722 bp, Homo sapiens
  misc_feature: GZ8MTXP02HOIN6.38.25.C03.1.454.CMB.2.raw
  modified_base (245)..(245): a, c, t, g, unknown or other
  modified_base (276)..(276): a, c, t, g, unknown or other
  modified_base (557)..(557): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcattccttttcttggtggcagtagcaacaggtcgcccactcccgaggttcaattggtgcagtctggagctgcggtgaagaggccgtggggcctcgagtgaacgtctctgcagcttntggttactactttagctagttatggtgtacngcgtggtgcgacgacggccctggacgaggtctggaggtggaggtgggatggactacgagtactaactttaagaagtaggaaaacaacgtaaaagtctagacccctaataatttaacgttaccgagggtaccaagtacgtactatacactacgaaccaacgacaaccacacgtaccgaacgcgtaccacgtacacccgtaagtagtacgaacgtacggaaacgggttaacctagggtaaactggttacgtaaccggaacgtaaccgaacggtttaaaccttntttaaaccggtttgttacggtaggtaaccgtaaaggtaaaccgttaaacctttaaaccgttacccttaaccgtttaaacgttaaaacttacgtttaaaaccggaaacgttaacgtttaggggtaaaaccgttttcggtaaaccttttttacgggtttttaacccg

SEQ ID NO: 436689 - DNA, 758 bp, Homo sapiens
  misc_feature: GZ8MTXP02INIUH.38.25.C03.1.454.CMB.2.raw
  modified_base (437)..(437): a, c, t, g, unknown or other
  modified_base (443)..(443): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcgagtgaacgtctcctgcaaggtcttcgtggttactacttttagctagttatgggtgtcgagtcgtgggtcgacgacgacggccccgtggaccgaagggtcttggaggtggagtggggatggatcgaagacctaaattaacgaaagtaacggaaaaactaacgaaaagtataccgaactaaacttaattaacttaccggaaaggtacaaggttactanaactanaacgtacgaaacccaagaaacgaaccaaccaactaacccgaggaactaccctaacgtaccgaacctaaacgtacgtaaacgggaaaccttaaacgggaaacggtaaacccgtaggtaaccgtaagtaccggtacgaaacccgtaacgtaacccggttacttttaaaatagtttacgttaagcggtaaacgtaaggaaaccttaaaaccgttaaaaccgtttacccgttaaacccttaaacgttaacctttaaaaggttaacggtaaaacggtagttaaaacggttacgtttaaaccggtttaacttttttaacgg

SEQ ID NO: 436690 - DNA, 812 bp, Homo sapiens
  misc_feature: GZ8MTXP02GD6KA.38.25.C03.1.454.CMB.2.raw
  modified_base (219)..(219): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctnagtgaacgtctccgtgcaaggtcttcgtggttactacttttagctagttatggtgtcagtcgtggggtcgcggacgacgggccccgtaggaacgaaggggtcttaggaggttggaggtagggagtgggtatacgagctaacgtttaaacgaagtaacggaaaacgtaaacgtaaaagtacgtacgacaactaattaaccgtttacgacgggttacagtacgtacgtataccgtagtaacgaacccgtaaacaaacggtaaccaaaccgtaccttaacccgaacgaaccgggacctaaccggttaacctacccccgttaaagaccgttaacgggtaaaccgtacgggtaaacggggtaaccccgttaagaaaccggtagtaccgtaacggttaaaccgcgtaacgggtttacctttaaagttaccgtttaggttcgtacggtaaccggaaaagtaccgtttaaaacggtaaacccgttttacccgttaacccgttaaatttaacccgttaaacggttttaaaccccggggaaacggtttaaacggttacggggttaaaagggttttcgttttaaaccctttttttaaacccggg

SEQ ID NO: 436691 - DNA, 684 bp, Homo sapiens
  misc_feature: GZ8MTXP02FW2BR.38.25.C03.1.454.CMB.2.raw
  modified_base (470)..(470): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttctggttactacttttagctagttatggtgtcgagcgtgggtgcgacacggcccctggaccgaagggtcttaggagtggagtggggatggatacgagactacttaacaagtaggaaaaccagtaaaagtatacgacaactaattaaacccccctttgaacggggacagtacgtacaatctaatacgaaccaacacgaacaacactacccgagactcaactcgacctanagtacgaacgtaggaaacgtacgtagaagtactacgaacgaccgaaccgtaccggttaacctttaagttaacgtttacggttacggtacgtacggtaaaggtaaaacgtaaacttaaaaccttttccccgttaaaccttaaacgttaagtttaaaaccgttaaacggtaaacgttaacggttaagggtaaacgtttacgtttacctttttaacg

SEQ ID NO: 436692 - DNA, 702 bp, Homo sapiens
  misc_feature: GZ8MTXP02GFV2G.38.25.C03.1.454.CMB.2.raw
  modified_base (344)..(344): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttatggtgtcagcgtggtgcgacgacggcccctaggacaagggcttaggagtggagtgggatggatcgagctaacttaanaacgttaggaaaacaacgaaaagttatacgacctaaataagttaaacgtttaccgaaggacgaaggtacgtacctaagttaccgaacgtaacgaaacaaaccgaaacgaacaaacctagtaacccaaacggataccgacttacggacccttaaacaacgtaacgggaaacctacggaaacgggtaactacgggaatacgttacgacggaaccgaacgtaccggtacttaagtaattagttacgtagacggtaaagtacgtaaaacttaaacctttacccttaacctaacgttaaactaacgttaaacggtaaccggttaaaacggtagtaaaaccggtttacgtttaacgttttaacg

SEQ ID NO: 436693 - DNA, 632 bp, Homo sapiens
  misc_feature: GZ8MTXP02FMK54.38.25.C03.1.454.CMB.2.raw
  modified_base (327)..(327): a, c, t, g, unknown or other
  modified_base (430)..(430): a, c, t, g, unknown or other
  modified_base (435)..(435): a, c, t, g, unknown or other
  modified_base (442)..(442): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccataccaactcgacaagtccagccaagtagttgttttaacacgtacggtaccaaacaataaagtaattactcgtacttacgtaccagacaacgaaaccaggacacgcctactaagtcnctctattacgcggactacgtccgtacccggggacggtcccggggtcctacggacgtacttcgacggtcggacacggcggtctgacgacgtagtacttcactcncactntacgacncgagcccgtgaccgtaggtctaagagtagtcggtacggtaatttagtttacgttactgtacgacgtataggtttataagtacgttactcgtaacgtaggttaccgggttcggggacccggggaactaacggtcggaacggtaagtacccgaaagtaaacccggaggttcgtacggctacggacctaaccg

SEQ ID NO: 436694 - DNA, 696 bp, Homo sapiens
  misc_feature: GZ8MTXP02FQ4KH.38.25.C03.1.454.CMB.2.raw
  modified_base (433)..(433): a, c, t, g, unknown or other
  modified_base (451)..(451): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcattctggagctgcggtgaaggaggccgtggggcctcagtgaacgtctcctgacaaggtcttcgttggttactacttttagctagttatggtgtgagtcgtgggtgcgacgacggccccgtaggacgaagggtcttaggaggtggagtgggataggatcgagtactaacttacaagtaacggaaaacaacgaaaagtatcgactaactaattaacgttacgaggacaggctacaatcatacgaacacanacctaacactaccgaganccacgtcgacctagacgttaacggaacgtagaaggtaacccgtagaacgtacgtaacgtacggaaacccggtacgtaaccccggtttaatttaacgttaagtttttagtacgggttaggaaccgtaaaggtaaaacccgttaaactttaaacccgttacccctttaaacgttaaccttaaaagttaaaccgtaacgggtaaacttaggttaaagggtttacttacccggtttattttttaaccgg

SEQ ID NO: 436695 - DNA, 729 bp, Homo sapiens
  misc_feature: GZ8MTXP02GF0NY.38.25.C03.1.454.CMB.2.raw
  modified_base (532)..(532): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcgaaggtcttcgttggttactacttttagctagttagtggtgtacgaggtcgtgggtcgacgaccgacgggtccccgtaggaccgaagggtcttggaggtggagtgggaagtcggaatcgaagtccgtaacgttaacgaaagtaacggaaaactaacgtaaagtataccgaacgtaaactaacgtttaaaccgttaccggaaggggtactacgggtaacgtactaaacgttacgagtaacgaaaccaacgaacgaacaaccgacaacccgaggaacactaccgtacgtaaccccttanacggttaacggaaaccttacgggaaacggtaaaccctaggacgtacgttcgaacccggtaacgacgtaacggttacctttaagtagtttagttacggtacggaacgtaaaggtaacctaaacctttaacttacccgttaacttaacgtaacttaacgttacgaagttaccgtaggtacgttacgtttactttttacg

SEQ ID NO: 436696 - DNA, 779 bp, Homo sapiens
  misc_feature: GZ8MTXP02INSMF.38.25.C03.1.454.CMB.2.raw
  modified_base (726)..(726): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagcgtggcggtaggaaggaggccgtggggcctgagtagacgtctctgcaaggtcttcgttggttactacgttttagactagttagtggtgtcaggtcgtgggtcgcgtacgacggccccgtaggacgaagggtcttggaggtaggaggtgggacgtaggatacgaacggcgttaaacgtttaaacgaaaggttaacgggaaaaacctaaacgtaaaaggtactaccgtaaacctaaacttaaacgttaaacgtttacccgggaaagggtacctaaggggtacttaaccgaagttaccgtaaacgtaccggaaaccctaacgaaaccgtaaaccaaacctaaccgtaacccgaacgtaacggacctaccgttacgtaaccctaacgtacgtaacgggtaaacggttacggtaaacgggtacctaaggtaacgtacttaccggtagaaccggttaaccgacggtttaaacttagttaagtttacgtaggtaccgaaaggacgtaaactaaaccttaacctttacctaacctttaanaacgttaacgttaacgaagttacggtacgttaagtttcgttaaactttttcgg

SEQ ID NO: 436697 - DNA, 591 bp, Homo sapiens
  misc_feature: GZ8MTXP02FVTR6.38.25.C03.1.454.CMB.2.raw
  modified_base (418)..(418): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatcttctggtgcctacggggacatcgtgatgacccagtctccagactccctggctgtgtctcgtgggcgagagggccaccatcaactgcaagtccagccagagtgttttacacaggtaccaaacaataaagtaattacttcgcttacggtaccagcaagaaaccaggacagcctactaagtgctactatttacgtggacacgtccgtaccgggtacgtcccggggtcctacgtaccgtacttcgacggcgcgacggcgggtctgagacagtattcactctacacatcancacgcctgcgagcgtagaaagtgtaggtgtacttagtttattacgtgtacacgatagttaattaagtagttaagtcctacgtaacggttacgtttcgggggaaccggggtaacctaaggacgtaggtagaaactaacgaaaacgtaactagggtacgacggtacaccgtaacg

SEQ ID NO: 436698 - DNA, 653 bp, Homo sapiens
  misc_feature: GZ8MTXP02HHE3U.38.25.C03.1.454.CMB.2.raw
  modified_base (281)..(281): a, c, t, g, unknown or other
  modified_base (391)..(391): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtcgtggagctgcggtgaagaggccgtgggcctcagtgaacgtctcctgacaaggtcttcgtggttactacgttttagctagttagtggtgtacgngtcgtgggtcgcgacgacggtccccgtggacgaagggtcttaggaggtggagtggggatgggatcgaggactaactttaacgaaagtacggaaaaactaacgaaaagttnacgaccaactaagttaactttcggaagggtacaggtacgttacaacttcaagtacgaaaccacgaacgactaacacgaccaacgacgactaccgacgtacctaacagtacggaacgacggtaaacgaccgtagaagctacgacgaacgacgtacgtacctattacttgtacggtagacgaaggtaactaactaaccttacctaccttaactaagttaacgtaacgtaacgtacgtaaggtacgtttagttacctttttaacg

SEQ ID NO: 436699 - DNA, 741 bp, Homo sapiens
  misc_feature: GZ8MTXP02GJQBP.38.25.C03.1.454.CMB.2.raw
  modified_base (256)..(256): a, c, t, g, unknown or other
tcagtcgatcacgtcacgaccggtgctcgatttagtagtgtagatttggggtttggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgacaagtccagccagtagttgtttacacaggtaccaaanaataaagtaattacttcgcttaggtaccagacaagaaaccaggacagccctactaaagttgactactatttacgtgggacctacgtcccgtacccggggtacgtcccggggtaccctacggtaccgtacgttccgacggccgggacgaacgggtccggggttactacgggaagaaccgtaaagtaactttccaaacttcctaccaaacccgtaatacccaaggacctaaacgtcccgtacggaccgtaacgggaccgtaaggaaaacgtggtttaaccgggtagggtaaacctttaaggttttaactttaaccgttcggtaactaacgtacgttaaagttaaactttaagtaacgtttacggtaccttaccggtaaggtttaccgggttttacggggaccccgggggtaaactaaggtaccgttaagggaataaacgtaaaccgaaaaccggtaacggtcgtagggtactacggtacctaaaccg

SEQ ID NO: 436700 - DNA, 668 bp, Homo sapiens
  misc_feature: GZ8MTXP02H9X0D.38.25.C03.1.454.CMB.2.raw
  modified_base (217)..(217): a, c, t, g, unknown or other
  modified_base (336)..(336): a, c, t, g, unknown or other
  modified_base (510)..(510): a, c, t, g, unknown or other
  modified_base (603)..(603): a, c, t, g, unknown or other
  modified_base (630)..(630): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctnagtgaacgtctcctgcaaggcttcgttggttactactttagctagttagtggtgtcagcgtgggtgacgacgcggcccgtaggacgagggtcttaggaggtggagttgggatggtaacncgaacggacctaacgttaacgaagtaaacggaaaaacaaaccgtaaaagtacgtacggaccaaactaacgttaaactttcccgaaggggctaggacgtactaaattccaaacgtccgaaaccaacgaacgaccaaaccacgtacccgaaacgacgacctactacggaccctaanaccgtaggaaccgtacggaaacggtaccgtaggtactagtcgtaaccgacggacgtaacggtcctttaagtagttagtacgtgaccggtaaanacgtaaactactttaccacctttaaanacgttaacgtacgacgtagtagtacttagttactttag

SEQ ID NO: 436701 - DNA, 682 bp, Homo sapiens
  misc_feature: GZ8MTXP02HWO53.38.25.C03.1.454.CMB.2.raw
  modified_base (244)..(244): a, c, t, g, unknown or other
  modified_base (272)..(272): a, c, t, g, unknown or other
  modified_base (561)..(561): a, c, t, g, unknown or other
  modified_base (606)..(606): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttntggttactacttttagctagttatggtntcgaggcgtgggtgcgacgacgggtccccgagggacgaacggggtcttggaggtggaggtggggtagtcggggattcgagtaccgtacttaacgaaagtacggtaaaacaaaccgtaaaagtatacgactaaacgtattaaacgtttccggaaggtacgacgggtacttacacgtacctaacgtacgaaacccaacgaacgaaacctaacgactaaccgacgacgtaccaaccgtcgacctaaccgagtaacgactaggggaaccgtaccggtagtacgggtataccgnggaacggaaccgtccggtaactttagtactttaagtcggttaacnccggaagtacctaaattaccttaccttacctaataacgtaagttaaccgagtacgaggtacgtttctttacttttg

SEQ ID NO: 436702 - DNA, 600 bp, Homo sapiens
  misc_feature: GZ8MTXP02JCREK.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagctagttatggtgtcagctgggtgcgacaggcccctggacgaagggtctgagtggagtgggatggatcgagcacttaacaataggaaacaacaaagtactgacaacataacgtttcagggcagagtcataccagtacgacctacgacgacacactaccacgacgacaccgtgaccctacgacgtggaaacttggaacgggtaacccttggaacgtacgtaccgtaggaccgtaccgacggtaccttatagttagtgtacgcggtaaagacgtaactaaacgttcccttaccgttacaaagttaacgttaacgacgtaacgtggtaacggttctcgtttttaac

SEQ ID NO: 436703 - DNA, 690 bp, Homo sapiens
  misc_feature: GZ8MTXP02HANGY.38.25.C03.1.454.CMB.2.raw
  modified_base (207)..(207): a, c, t, g, unknown or other
  modified_base (538)..(538): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggnggccgtggggcctcagtgacgtctcgtgcaacggtcttcgtaggttactacttttagcgtagttagtggtgtcgagtcgtggtgacgacgcggtccccgtaggaacgtaagggcttaggacggtggagtgggactgggactcgagtctaacgttacgaagtacggaaaacaacgtaaaaggtactacggactaacctaaagttaacgtttacccggaaggggtacaggtacgtactaacgtactaacgacgaaaccacgaactaaccactaaccacgaacacgacacgtcgaaccttagacgtcggaaactaggaacgtaaccgtagaacncgttacgcgaaacgtaccggtaacgttacttacggttattacgtaggtagtacgaaggtaactaaaaccttacgttaccctttaacgtaactttaacgtaacgtttaaccgacggttaagttaaccggtagttttacctacgttttttaacg

SEQ ID NO: 436704 - DNA, 634 bp, Homo sapiens
  misc_feature: GZ8MTXP02FU8O9.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacacggcccctggacgaagggcttgagtggagtgggatggatcgagactacttacaagtacggaaacacgaaagtatcgacacaattaacgtttccgaaggggcaggacgtacaattacaagtacgaaccaacgaacgaacaaccaactacccgaacgaacgacccaaccgttacgacccctaacgaaacgttacgggaaaacccttgggaaacggtaacccgtaggacgtactacgtacgaaccgtacgaccggtacctttaagtagtttagtggtagacgagtaacgaaacctaacttaccctactactaataacgtacgaacgacgtaggtaactcgtacttttaacg

SEQ ID NO: 436705 - DNA, 599 bp, Homo sapiens
  misc_feature: GZ8MTXP02HEKA2.38.25.C03.1.454.CMB.2.raw
  modified_base (290)..(290): a, c, t, g, unknown or other
  modified_base (363)..(363): a, c, t, g, unknown or other
  modified_base (393)..(393): a, c, t, g, unknown or other
  modified_base (422)..(422): a, c, t, g, unknown or other
  modified_base (428)..(428): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttagtggtgtcagtcgtgggtgcgacncggtcccctggaccaagggtcttggagtggagtggactggatcgagcattacagtacggaaacacgaaagtanacgacatatactcgagacagtatcatacanacgacacacacacacacgagacgtacacncgacanacgtacgaacgtacggacgtacgtagacgtacgacgtacgacgacgtaccgttacttaagttacgttagtacggtacgtacggtaaacgtaaactaaaccttaaccgttacctaaccgtaactaacgtaacgtaacgaacgtagtaacggtacgttacgtttaacgttacg

SEQ ID NO: 436706 - DNA, 790 bp, Homo sapiens
  misc_feature: GZ8MTXP02JENEV.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggtccctggacgaagggcttgagtggagtgggatggatcgagcacttacaagtaggaaacacaaagtatacgacaacgtaattaaagtttcccaaggggttaccagggtaacgttacaaacgttaccgaagttacggaaacccaaccgaaacggaaacctaaacccgaacttaacccccgaaacggtaaccggaccctaacccgttacgtacccccttaaaccgaagttaccgggaaaaccgttacgggaaaccgggtaaaccccgttagggaaacggtaacgttacccgttaacgggaaacccgtaacccggtaacccgggttacccttttaattaaacgtttacgtttaggtacggtaaccggtaaaggtaaaccggtaaaaccgttaaaaccgttttccccgttaaaccccgtttaaacgtaacctttaaaacgttaaacccggtaaaccgttaaggtaaccgggttaaaacggtttacggtttaacccgttttttaaacg

SEQ ID NO: 436707 - DNA, 641 bp, Homo sapiens
  misc_feature: GZ8MTXP02GRB9E.38.25.C03.1.454.CMB.2.raw
  modified_base (374)..(374): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttcgtggttactacttttagctagttagtggtgtcagcgtgggtcgcgacgacggccccgtggacgaagggtcttaggaggtggagtgggagtggatcgagctaacttacaagtacggaaaacactaaagtanacgacaactattaacgttccgagggtacaggtagtacactacgagtaccgaaccaacgaacgacaacccactacccgaacgacgacctacgtccgtaaccgttaacacgttaacggaaacgttacggggaaaccgtaacccggtaggaacccgtagttaccgaaccgggaacgaccgtaccggttacttaagttacgttagttcgtagacgtaagacgtaactaacttcctactaactataacgtacacgtagagactgtactttag

SEQ ID NO: 436708 - DNA, 671 bp, Homo sapiens
  misc_feature: GZ8MTXP02IBV8M.38.25.C03.1.454.CMB.2.raw
  modified_base (620)..(620): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggcctggggcctcagtgaacgtctcctgcaaggtcttctggttactacttttagctagttatggtgtcagtcgtgggtgcgacgacggccccgtaggacgaagggtcttaggaggtggagtgggatggatcgagactaacttaacaaagtacggaaaaactaacgaaaaagtctacgacctaaacgtaatttaaacgtttacccgaaggggtacagggtattaccaaattaccgaaatcggaaacccaacgaaacgtaaccacctaactacccgaaacggacgacctaacgtacgaccctaaacgagacggaaacgtggaaacggaacctggaagtactcgagaaccgacgaccggtactttaatagtttagtgtacgagtaggtaaactaactaaactttcctaacctttaanaacttaagttaaaccgagttaagtacggtaaagtttcgttactttttaacg

SEQ ID NO: 436709 - DNA, 751 bp, Homo sapiens
  misc_feature: GZ8MTXP02JPAH1.38.25.C03.1.454.CMB.2.raw
  modified_base (411)..(411): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactccaggttcaattggtgcagtctggagctgcggtgaagacggccgtggggcctcgagtcgaacgttctaccgtgacgaaggtcttacgttggtttaacctacgttttagacgtagtttagtcggttgtcgaggtcgttgggtcgacgtaacgcggccccgtaggacgtaagggtctagaggtggagttaggggatggattcgaggtactaactacgaagtacggaaacacgtaaagtataccganacctaagttaacgtttcggaagggtactagggtaactacgtaaacgttaccgagttacgaaaccgtaacgacgtaaccaaactaacgtaccgaaacggaacgttacccggacctaagtacccccgttaagacggtaaccgttaaacgcgggtaacgaaaacgtcgtaaacggtcgttaacgacccgtaaggtacccgtaacggttacctttaacgttaagttaacgtccggtaggtaacggtacgggtaaacgtaaacctttaacggttaaccccttagttaacgtaaccgtttaagacgtaaacgtacggttagtacgtttaacgtaggtttttaaccg

SEQ ID NO: 436710 - DNA, 691 bp, Homo sapiens
  misc_feature: GZ8MTXP02F1PHV.38.25.C03.1.454.CMB.2.raw
  modified_base (382)..(382): a, c, t, g, unknown or other
  modified_base (680)..(680): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaaggaggccgtggggcctcagtgaacgtctcctgcaaggtcttctggttactacttttagctagttagtggtgtcgaggtcgtgggtgcgtacgacggtccccgtaggacgtaagggtcttaggagtggagtgggatggatcgagtactaacgttaacgaagtaacggaaacataaagtntacgaccaactaattaacttccggaacgggtacaggtagtactaaattccgaagttaccggaaccaagaaacgactaaaccgacgtaacccgaacggaacgtacccacgttaccgtaaccctaacgtaaacgttacggaaaaccgttaccggggaaaacggtaacccgttagaacgtaacgttacgaacggaacccgtaacgtaccggttacttaattaagtttacgtagtcggaacgaggaaacttaacctaaacttccgttacctaatacgtaacgtacgaacgtagtacggtatnttactttaacg

SEQ ID NO: 436711 - DNA, 605 bp, Homo sapiens
  misc_feature: GZ8MTXP02I1X6F.38.25.C03.1.454.CMB.2.raw
  modified_base (242)..(242): a, c, t, g, unknown or other
  modified_base (379)..(379): a, c, t, g, unknown or other
  modified_base (414)..(414): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcgtgggcctcagtgacgtctccgtgcaaggtcttntagttactacttttagctaggttatggtgtcgagtcgtgggtcgacgtacacggcccctaggaaccgtaagggtcttaggaggtggagtgggtagtggatcgagtcgtaacttacgaagtacgaaactacaaaagtntcgactacgtaataacttacgaggacagtacgtanacgtcagtacgacacagacacacgaccgacgacgactctacgacctacagtacgtaaacgtaggaacggaaccgttggatacgtaccgagaaccgtacgtacggtacttattagttattggagtacgtagactaacctaacttcctactaactataactacgtaacgtacgtagtagtacttacgtttaac

SEQ ID NO: 436712 - DNA, 609 bp, Homo sapiens
  misc_feature: GZ8MTXP02F8HGE.38.25.C03.1.454.CMB.2.raw
  modified_base (250)..(250): a, c, t, g, unknown or other
  modified_base (297)..(297): a, c, t, g, unknown or other
  modified_base (357)..(357): a, c, t, g, unknown or other
  modified_base (374)..(374): a, c, t, g, unknown or other
  modified_base (398)..(398): a, c, t, g, unknown or other
  modified_base (413)..(413): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtcgcccactcccaggttcaattggtgcagtctggagctggcggtagaaggcggtccgtggggacctcagttggaactctcctgaccaaggtnttcgtggttactactttttagctaagttgtggtcgtcaggtcgtggngcgacgtcggccccgtggacgagggtcttggaggtgagtgggatcggatgagctacttanaagtagaaacagaagtncacctataagtacttgaaacgggnagacgtacactcganacgacacacacacacgacgacgacgacactacgtacgtacgtacgtacgtacgtacgtacgtacgtagtacgtacgtacgtacgacgtacgtacgtacgttattagttagtagtacgtacgtaacgtaacgtaacttaacttaccttactaactagtaacgtaacgtacgtacgtagtacgttacgttacgtttcg

SEQ ID NO: 436713 - DNA, 641 bp, Homo sapiens
  misc_feature: GZ8MTXP02F2BOF.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagcgtgggtgccgacgacggcccccgtaggacaaggggtcttaggaggtggagtgggatggatcagactaactagaataggaaacaacaaagtatacgacaactagttaaactttccggaaggtactagaacgtactaagtacctagtacgaaacacgaacgaaccaacgtacaaccgacgaacgacctctaccgtaactacgaaacgtacgaacgttaaggaaacggttaaccgagtacgtaacgtccgacgaactaaccggtacttaacgttattagttacgttagcgacgtacgaaacgtaactaacgttccttaactaacgttaataacgtacgaactaggtcgtaattacgttactttaag

SEQ ID NO: 436714 - DNA, 573 bp, Homo sapiens
  misc_feature: GZ8MTXP02H9OMK.38.25.C03.1.454.CMB.2.raw
  modified_base (478)..(478): a, c, t, g, unknown or other
  modified_base (497)..(497): a, c, t, g, unknown or other
  modified_base (525)..(525): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgagaggcctggggcctcagtgaacgtctcctgcaaggcttctggttactacttttagctagttatggtgtcagcgtgggtgcgacacggcccctggacgaagggcttggagtggagtgggatggatcagcacttacataggaaacacaaagtactagacactaataactttaccgagggtacagtagttcataccatacgaacacagtacactacaccacgaagcaactgacctacagtagactgaacgactagagtatcacgacgatacgctttaanacttagtgtgacggtaaanaacgtaaactaacttaccttacgttaanaacgttaacgtaacgaacgtacgttaacggtacgttacttactttacg

SEQ ID NO: 436715 - DNA, 660 bp, Homo sapiens
  misc_feature: GZ8MTXP02GGVI9.38.25.C03.1.454.CMB.2.raw
  modified_base (205)..(205): a, c, t, g, unknown or other
  modified_base (292)..(292): a, c, t, g, unknown or other
  modified_base (490)..(490): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagnggcctggggcctcagtgaacgtctcctgcaaggtcttctggttactacttttagctagttagtggtgtcgagtcgtgggtgacgacncgggcccctaggaccgaaggggtcttggaggtaggagttgggattgggaactcgaaggtccaactttaacgaaagtacggaaaaccaataaaagtacgtagactaacctaattaaaaccgtttccgaaaggggctaggggtagttaccgaagttaccgaatacgaaccaacacgaacaacaacaccacgacgacaccncacgaccagacggaaccgtagaacgaccgagaggactacgacgacgacgaaccggtaccttaagttaattagttagtacgtacgaacggaaacgtaaacgtaacgttaccttaccttaactaacgtaacgttaacgtaacgtaacgtacggtacgttacgttactttacg

SEQ ID NO: 436716 - DNA, 627 bp, Homo sapiens
  misc_feature: GZ8MTXP02IHNP3.38.25.C03.1.454.CMB.2.raw
  modified_base (280)..(280): a, c, t, g, unknown or other
  modified_base (287)..(287): a, c, t, g, unknown or other
  modified_base (332)..(332): a, c, t, g, unknown or other
  modified_base (450)..(450): a, c, t, g, unknown or other
  modified_base (461)..(461): a, c, t, g, unknown or other
  modified_base (478)..(478): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtctttcgtggttactactttttagctagttatggtgtcagngtgggcncgacacggcccctggacgagggtctggagtggagtgggatggatnacgcacgtttaacaagttacggaaaaccactaaaaggtattacggtaacctaattaacgtttaccgagggactaaggtagttcaagttaccaagttaccgaaccaacaacggaaccanactacgacganaccacgtacgacctaanagttacgaacgtaggaaccgtaacgtggaactactagtaccgacgacgtacggtactttaattattaagttgacgtacgagtaaactaacttaaaacttctacctaaagtattaataaccgagtagtacggtattctactttactttcg

SEQ ID NO: 436717 - DNA, 659 bp, Homo sapiens
  misc_feature: GZ8MTXP02HHSYD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacacggcccctggacgaacgggcttggaggtggagtgggatggatcgaggctaacgttaacaaagtacgggaaaaacaacgaaaagtatacgacctaactaattaaactttaccgaagggacagtagtacaatacaatacgaaccacaacgacaacactaccacgacgcaacgtcgacctacagtacggaaacgtaggaaacggtaacctagaacgtacgttaacgacggaaaccgaccgtaaccggtactttaaacgttacgtttaagtacggtacgacggtaaagaaacgtaaaccttaaaacctttccctaaccgttaactaagttaacgtaacgaaacgtacgtaaggtaagttacggttacttttaacg

SEQ ID NO: 436718 - DNA, 740 bp, Homo sapiens
  misc_feature: GZ8MTXP02FV5EZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacaagggtcttggagtggatggggatgggatcgagctaacgttaacaaagttacggaaaaacacgtaaaaaagttataccgactaacctaaattaaaccgttttaccggaaggggacctaggggtaagtacccaaagttccgaaattcggaaacccaacgtaaagaacccaaacaaccttacccgaaacggaacgaccaacccttacggacccttaaacgaaacgttcgggaaaaacgttcggaaacgggtaaaacccgtggaaagtaacgttaccgttaacgaaaccggtaaccgtaccgggttaaccctttaaagttaacgtttaacgttgttaacggacggttaaacggaaacgtaaaaccttaaacttttcccctaaccctttaataactaaacgtttaaaccgaactaacgttagtaaaaccggtgtactttttaacg

SEQ ID NO: 436719 - DNA, 516 bp, Homo sapiens
  misc_feature: GZ8MTXP02FEW1E.38.25.C03.1.454.CMB.2.raw
  modified_base (387)..(387): a, c, t, g, unknown or other
  modified_base (412)..(412): a, c, t, g, unknown or other
  modified_base (498)..(498): a, c, t, g, unknown or other
tcagtcgatcacgtcacgaccggtgctcgatttagtagtgtagatttgggtttgggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggccccctggacaagggcttgagtggatgggatggatcagcacttacaatggaaacacaaagtatgcacataatttccagggcagagtcatcatgaccanagacacatccacgagcactgcctanatggaactgaggaacctgagatctgacgacacggccttagtattatgtgcgagagacaaagttcctactacataagtacgacgtanggaaacgtgacttttaac

SEQ ID NO: 436720 - DNA, 569 bp, Homo sapiens
  misc_feature: GZ8MTXP02FL309.38.25.C03.1.454.CMB.2.raw
  modified_base (381)..(381): a, c, t, g, unknown or other
  modified_base (423)..(423): a, c, t, g, unknown or other
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgcctacggggacatcgtgatgaccagtctccagactcctggctgtgtctctggcgagagggccacatcaactgcaagtccagccagagtgttttacacaggtccaacaataagattactcgctggtaccagcagaaaccaggacagccctacctaagttgactctatttactggggcagtcctacccggggtaggttcccggggcctcgaccgacttcacgcggcaggcggtctgagacagtntttcactctcacccatcagcagcctgcaggctgaacgtatgngctagtttatacttgtcagacagttaattagtaagtacgtcctactacgtacgttttcggggacccgggggacaaacggtaccgttaggaacgtaacttaaccgaaaaacgtaaccgttacggtcgggtacttcggacctaacccg

SEQ ID NO: 436721 - DNA, 707 bp, Homo sapiens
  misc_feature: GZ8MTXP02GFLBW.38.25.C03.1.454.CMB.2.raw
  modified_base (421)..(421): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtgggcctcagtgaacgtctccgtgcaaggtcttcgtggttactacttttagctagttatggtgtctagcgtgggtgcgacgacggcccctggacgaaggtcgttgacggtggagtgggactgggatcgagctaacgtaacaagttagggaaaacacgtaaaagtacgtacgaccaactaattaacgtttccgaaggggactaggtacgtanagttacctaaggtacaaccgaacaaacgacaaacgactaacccgaacggacacctaccgtcggtaaccccttagaacgtaggaaaccttagacgttaacgaaccgtagtaaggtactaccgtaagaccgtaaccgtaacgttaccctttaagttacgtttaacggtaggttaccggaacggtaaaggtaaacccgtaaacttaacccgtttaacccttacctttaaactaacgtttaacgtaaccggtaacgttaagttacggggttaaaatttcggtttttaacg

SEQ ID NO: 436722 - DNA, 705 bp, Homo sapiens
  misc_feature: GZ8MTXP02JXDK2.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcgaaggtcttctaggttactacttttagctagttagtggtgtcgagtcgtgggtgacgacgacggtccccgtggaacgaacggggtctttggaggtgggagttggggagtgggatacgacggtacctaacttaacgaagttaacggaaaacaacgtaaagtagtacgacaactacttaacgtttccgaggggtacacggtagtactacttacgaatacgaaaccacgaaacgaacctaaccaactacccgaaacgacgaccaacgtaccgtaccctaaagacgttaacggaaacgtacggtaaacggaacccgtgggaaactagttacaacggtacaaccggtaccggtactttaagttaatttacggtaggtacgaagtaacgaacgtaaaccttaacttaccctactttaacgtaccttaaagttcccggtaaacgtagtacgggttacttaacggtactttttaacg

SEQ ID NO: 436723 - DNA, 701 bp, Homo sapiens
  misc_feature: GZ8MTXP02ICK84.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactactttagctagtttagtggtgtcaggtcgtggtcgcgacgacggcccctaggaccgagggtcttaggagtggagtagggatggatcgagacctaacttacaagtacggaaaactacgtaaaggtatacgactaactaataacgtttaccgaaggggtcaggtactacgactacagtacgacaacgacacatacgcaacggacttacacttcgacctaacgtagtacggtaaacaggtaaaccgggaaccttggaacggtaacttccggaacgaacggtaccgtaccggttaccttttaagtacgttttagtacgggttagtaaccggaaggtaaaccgtttaaactaaaacccgttttcccttaaacccggtttaattaaaacgttaacggtttaacccggaacgttaaccggttaagggttacctttggtttaaaacgtttttacccg

SEQ ID NO: 436724 - DNA, 692 bp, Homo sapiens
  misc_feature: GZ8MTXP02FKFJ8.38.25.C03.1.454.CMB.2.raw
  modified_base (378)..(378): a, c, t, g, unknown or other
  modified_base (401)..(401): a, c, t, g, unknown or other
  modified_base (471)..(471): a, c, t, g, unknown or other
tcagtcgatcacgtcacgaccggtgctcgatttagtagtgtagatttgggtttgggggacccaaaaaaccaacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacctacttttagctagttagtggtgtcagcgtggggtgccgacgacgggcccctgggaccgaaggggctttggaggtgggagtggggattggatcgagctaacttacaagtaggaaaacacaaagtancgcaacattaacttccgagggcngagttcatcaatacgaaccacaacgaacaaaccgactaccccgacgaagcccaaaccgttcgacccttanaacgtacgggtaaacctaggaacggtaaaccctggtaacgacgtaccgttacggaaaccgaaaccgtaccggtaaccctttaagttaactttagtttacggacgtacgaaacgtaacgtaaaaccttaaacctttacccttaacccttaataaaccgtttaaacgttaaacggtaaccggtaaggttacggttaaaacggtacggtttccttttttaaacg

SEQ ID NO: 436725 - DNA, 641 bp, Homo sapiens
  misc_feature: GZ8MTXP02IT39P.38.25.C03.1.454.CMB.2.raw
  modified_base (234)..(234): a, c, t, g, unknown or other
  modified_base (273)..(273): a, c, t, g, unknown or other
  modified_base (285)..(285): a, c, t, g, unknown or other
tcagtcgatcacgtcacgaccggtgctcgatttagtagtgtagatttgggtttggggacccaaaaaccaacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctccngcaaggtcttctggttactacttttagctagttatggtntcgagcgtgggngcgacgacggcccctaggaccgaagggtcttaggaggtggagtgggagtggatcaagacctaacgttaaacgaagtaacggaaaacaacgtaaaagtataccgacaattaacttaaacgtttaccgaaggggacaggtaacgtacacttacaagtacgaaaccaacaacgacaacaactaccaacgacgacacgtacactaacagtacgaaatcgaaggactagagtactacacgacgacgtacgtacttactattcgtagtagacgaaagtactaaacttaaacttcccttaaccttaacttaacttaacgtaaacgtacgtaaacggtaggtaaagttacgtttacttttaaac

SEQ ID NO: 436726 - DNA, 695 bp, Homo sapiens
  misc_feature: GZ8MTXP02HTWBP.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtagaagaggccgtggggcctcgagtggaacgtctccgtgcaaggtcttcgtggttactacttttagctagttagtggtgtcagtcgtgggtcgcgacgacggccccgtggacgtaacgggtcttggaggtggagtgggatggatcagctacttaacgaataggaaaacaacgtaaagtataccgactaacgtaattaaacgtttccggaacggggacagggtacttacaataccgtaataccggaaaccctacgaaacgtaaacctaaccgaactacccgaaacggactacctacgtacgaccctaacgacgtaggaaaccgtggtaaacgaccgtaagacgtacttacccgagaaaccggacctaacggttaccttaattagtttaagtggtagaaacgtagtaaactaaaccgtttaaacttcccttaaccgttaagacctttaaagtaaccggaacgtaacgtaggtaaccggttttactttacgttttaacg

SEQ ID NO: 436727 - DNA, 750 bp, Homo sapiens
  misc_feature: GZ8MTXP02HOY0L.38.25.C03.1.454.CMB.2.raw
  modified_base (280)..(280): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaggcttctggttactactttagctagttagtggtgtcgagcgtgggngcgacgacggcccctggacgaaggtcttggagtggagtcgggatggagtgacgtactacttaaacgaagtaacggaaaacgaacgtaaaagttagtaccggaacctaactaaacgtttaaacgttttaccggaaacggggtactacggggaacgttacaaacgttacgtaaactaacggaaacccaaacaaacggacccaaacacctacccgaacggtacgtaccgtaactttacggaaccctttaacgaacgttacgggtaaacgtacggtaacggtaaacccgttagaacggtaacttacgtaacggacgtaaaccgtacggtacctttaagtaacgtttagttacggtaggtaacccgtaaggtaaaccttaaaccgtaaactttccccgtaaacgtttaaccctaatttaaaaccggtaaccgtaacggttaagtacggtaacgtttaccgtttactttttaaccg

SEQ ID NO: 436728 - DNA, 740 bp, Homo sapiens
  misc_feature: GZ8MTXP02F9YAH.38.25.C03.1.454.CMB.2.raw
  modified_base (297)..(297): a, c, t, g, unknown or other
  modified_base (523)..(523): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaggtcttgtggttactacttttagctagttatggtgtcagcgtggtgcgacgacggccccnggacgaagggcttggaggtggagtggggatggatcgagtaccacttaacgaagttacgggaaaacaacgtaaaaggttactacggacctaacgtaaagttaaacgttttacccggaacggggtacacgggtaacggttactaacgttacgaacgtacggaaaccctacgaaacgaactaaaccctacgtaacccgaacggtaacgaccgaccgttcgacccttaanaacgttacggaaacttacgggaaccggtaacctaggtagtaacgtaccgtacgaaaccggtaccgtaaccgggttacttaaccgttaagtttacgtttacggacggtaccggtaaaagtaaaccggtaaaccttaaaccgttcccttaaaccttaacgttaaacgttaacgttaaacgaacggtagttacggtaaggttacgtttacgtttttaacg

SEQ ID NO: 436729 - DNA, 634 bp, Homo sapiens
  misc_feature: GZ8MTXP02JXQ1Z.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggcctcagtgaacgtctcctgcaaggcttcgtggttactacttttagctagttagtggtgtcgagcgtgggtgcgacgacggtccccgtggacgaagggtcttaggaggtggagtgggatggatcgagtactaacttacgaagtacggaaaacacgaaagtactcgacaactataacgtttaccgagggacagtacgtacacgtacagtcgaaccacgacgaacacactaccgacgacgacacgtcgaccctagacgtacggaactaggaaggtacccgtagacgtacgttacgacgaacccggacgtacggttacttaagttagtttacgttagtacgacggggaataacggtaactaaccgttacctacctaacgtattaacgtaaccgtagacgtaggtaacgttacgttacttttaacg

SEQ ID NO: 436730 - DNA, 691 bp, Homo sapiens
  misc_feature: GZ8MTXP02JEP0D.38.25.C03.1.454.CMB.2.raw
  modified_base (205)..(205): a, c, t, g, unknown or other
  modified_base (275)..(275): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagnggccgtggggcctcagtgaacgtctccgtgcgaaggtcttctaggttactacttttagctagttatggtntcgagccgtgggtgcgacgtcggcccctggaccagggtctagagtggagtggagtggatcgagtctaacttacgaagtacggaaaaccgtaacgaaagtacgtacgactacctaagttaaccgttcgagggtaaccaggtacttacagtcaagtacgaaaccaactacgactaacgacaccgaacgacgacctaacgtacgtaccctaagacgttaacgaacggaacggttaaccggaaacccgtgaacggtacttccgaaacggaacgtaaccgaccggttacctttattaacgttacgtaggttaaccggaggaaaagtacgtaaaaccttaaacctttccccgtaactttaaacgaaaccgttaagttaaacccggaacgaggttacggtaaaactttggtaactttttaacg

SEQ ID NO: 436731 - DNA, 649 bp, Homo sapiens
  misc_feature: GZ8MTXP02F81I8.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttagtggtgtcagcgtgggtgcgacgacgggcccctggacgaagggcttggaggtggagtgggatggatcgagactaacgttaacgaaagtacggaaaacaacaaaagttatacgacaactaattaaactttccgaagggactagagtacagtacatacgaaccaacgaacgaccaacactaccagacgacacgtacgacctacagtacggaaactaggaaacggtaacctaggaacgtacgtaccgtaaggaacccgtaacggtacggtacctttaaagtaagtttagttacggtagacgaaagtaacgtaaaccttaaactttcccttaaccgttaactaagttaacgttaacgaacgtagtaggtaattcgttactttttacg

SEQ ID NO: 436732 - DNA, 705 bp, Homo sapiens
  misc_feature: GZ8MTXP02FOUA2.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagcgtgcggtgaagaggccgtggggcctgagtgaacgtctccgtgacgaaggtcttcgtaggttactacttttagctagtttagtggtgtcagtcgtggtgcgacgacgggccccgtaggaacgaacgggtcttaggacgtggagtgggagtacgggtatacgacgtctaaacgttaacaaaggttaaacggaaaactaaacgaaaaggttatacgacaacctaagttaacgtttccggaaggcaggtacgtacaaagtcctaaacgtacggaaccaaacgaaacgaacaaccacgtaccaagaacgacgaacctcgtaacccagaaagtacggtaaacgtgaaacggtaccagaacgtacgtacgaacgaaccggtacgtaaccggttactttagtaagtttacgttagtaggtacgtaaacggtacgtaaaacttaaccgtttacccttaactaaccttaaagtaacgttaaacggaacgttacggtagtaacgtcgtttacttttaaccg

SEQ ID NO: 436733 - DNA, 710 bp, Homo sapiens
  misc_feature: GZ8MTXP02F6VVZ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggcccctggacgaagggcttagaggtggagtgggagtggatcgagtctactaacaagtacggaaaacaacgtaaaaggtatacgacctaactaagttaaactttacccgaaggggtaccaggtacgtactaacgtacctagtacgaaaccaacaagaaccaacgtaactacccgaacgacgacctaccgtacgacccctaagacgttacggaaacgtacggaacggaacgtacggaagtacgtaccgtacggaaccgtaaccgaccggttacctttaagttaacgtttacgttagtacggaacgtaaacgggtaactaaaacttaaaccgtttaccccttaaaccttaacttaaacgtttaacgttaacccggaaacgttacggttaagggtaacgtttcggtttaacttttttaaccgg

SEQ ID NO: 436734 - DNA, 636 bp, Homo sapiens
  misc_feature: GZ8MTXP02GSTEN.38.25.C03.1.454.CMB.2.raw
  modified_base (428)..(428): a, c, t, g, unknown or other
  modified_base (454)..(454): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtcgaacgtctcctgcaaggtcttctaggttactacgttttagctagttagtggtgtcagtcgtgggtgacgacgacgggccccctaggacgaagggtcttaggagtggagtggggatgggactcgaggactacttaacaagttacgaaaacacgtaaaagtgtacgacaactataacgttcgaggacagatctatacatacgacanacgacacgtacaccgagtacacgacncgacctacgagtacggtaacaggaaacgaccgttagacgtactacgtacgaccgtacgacggttacttaattagtttagtacggtacgtaacgtaggaaacctaacgttaaaccttcccttaactaataaacgtaacttaacggaaccgtagttaaggtacgtaccgttttacgttttaacg

SEQ ID NO: 436735 - DNA, 642 bp, Homo sapiens
  misc_feature: GZ8MTXP02HR5QQ.38.25.C03.1.454.CMB.2.raw
  modified_base (449)..(449): a, c, t, g, unknown or other
  modified_base (456)..(456): a, c, t, g, unknown or other
  modified_base (478)..(478): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaagaggccgtggggcctcagtgaacgtctcctgacaaggtcttcgtggttactacttttagctagttatggtgtcaggtcgtgggtcgcgacgacggtccccgtaggaccgaagggtcttaggaggtggaggtgggagtgggatcgaggctaactttaacgaaagtacggaaaacaacgtaaaagtattacgactaataattaaacgtttccgaagggttacagtagtacataccagtagacccaanacgacanacaccagacgcactcgactaangtagaacgtgaacgactagacgtatacgaggaacgacgtacggtctttaaagtacgtttagtgtaggacgtaaggtaaactaacgttaaacttacccttacctaataacgttaacgtaaacggtaagtaacggtaagtaaccggttagtttacctttttaacgg

SEQ ID NO: 436736 - DNA, 690 bp, Homo sapiens
  misc_feature: GZ8MTXP02F0TKQ.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagtctggcggtgaaggacggccgtggggcctcagtgaacgtctcctgcaaggtcttgtaggttactacttttagctagttagtggtgtacgagtcgtgggtcgacgcgacggcccgtaggaccgaggtccgtaggaggtaggaggtgggatggactcgacgtactaacgttaacgaagtaaacgaaaaccaagtaaacgtactaccgtaactaaacttaagtttaaccgttacggaaacggttacgaggtacgttaacctaagtacgaccgttaacgaaacctaacgaaacgaacctaacacgtaccgaaaggtaccactaccgtacgtaccttacgacgtaagggtaactaacgggaacgtaccgtaggaactacgtaacgtaccgacgtaccgtacgttagttatttagtagtacgagtacgtagaaaccgtaacttaacgttccctaatacgttataaccgtgtaacgtacggtagtactttcgttacttttacg

SEQ ID NO: 436737 - DNA, 666 bp, Homo sapiens
  misc_feature: GZ8MTXP02IO9A6.38.25.C03.1.454.CMB.2.raw
  modified_base (183)..(183): a, c, t, g, unknown or other
  modified_base (205)..(205): a, c, t, g, unknown or other
  modified_base (464)..(464): a, c, t, g, unknown or other
  modified_base (483)..(483): a, c, t, g, unknown or other
  modified_base (512)..(512): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtncagtctggagctgcggtgaagnggcctggggcctcagtgaacgtctcctgcaaggtcttctggttactacgtttttaagctaagtttatgggtgtcagcgtggggtgcgactacggcccctggacaagggtcttaggaggtggagtggggatagggatcgagctaacttaacgaagtacggaaaacacgaaaaggtactacgaccaactaattaaacgtttacgaagggtcagtagttacagtacaatcgaaaccacaagtaaccagactaccgaacgaanccgtaactcggaccctaanacgtaggaaaccgtggaaagggtaaaccnggaacgtacttacgacgaacgaaccgacggttactactaagttacgtagtacggccgaaagaaccggtaaactaaacctttcctaaaccgttactaaaactaacgtttaaacggaaccgtaacgttaaggtaacgtggtttaacctttttaacg

SEQ ID NO: 436738 - DNA, 660 bp, Homo sapiens
  misc_feature: GZ8MTXP02IR6RS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtcgtggtgcgacgacggcccctaggacgagggtctgaggtggagtggagtggatacgagactaacgttaacaagttacggaaaacaacgaaaagtatagactaactattaacgtttacgaggtacaggtagtacatacatacgaaaccacgaacacaacactaccgacgacgacacgtacgacctaacgacgtacgtaaacgtaggaaacggtaaacccgttagaacgtacgttaacgtaccggaaaccgtaccggtaacgtaaccgttttaagttaacgtttagttacggttcggaaccggtaaagtaacgtaaaaccttaacgttaccctactttaacgtattaacgtacgtaagtacgtaggtaacgttgtacgtttttacg

SEQ ID NO: 436739 - DNA, 772 bp, Homo sapiens
  misc_feature: GZ8MTXP02FPG0A.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacacggcccctggacaagggtcttgaggtggagtgggatggatcgagcaacttacgaataggaaacactaaaggtatacgacaacgaattaactttaccgaagggtcaggtacgttcaattacgaatacggaaaccaacgaagaaccacaactacccgaacgtaacgacacctacggtaccctaacgtaacgttacgggaaaccgttacgggaaaacgggtaaaccccgttagggaaccggtaaacgttacccggttaaacgggtaacccggaaacccgtaaccgggggttaacccgttttaaattaagttttaaaccgtttagggttaacggtaccgggaaaggtaaacgggtaaaaccgttaaaaccgttttaaccccgttaaccccgtttaaagttaaaacccgttaaaagttttaaacccggtaaaaccgttaaacggttaaacgggtttaaaacggttaacggtttaacgtttttttaaaaccg

SEQ ID NO: 436740 - DNA, 739 bp, Homo sapiens
  misc_feature: GZ8MTXP02H7B9Z.38.25.C03.1.454.CMB.2.raw
  modified_base (295)..(295): a, c, t, g, unknown or other
  modified_base (338)..(338): a, c, t, g, unknown or other
  modified_base (381)..(381): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggccgtggggcctcagtgaacgtctcctgcgaaggtcttcgtggttaactacttttagctaagtttagtggttgtacagtcgtggggtncggacgaccggcccctggacgagggtcttggagtggagtgggntggatcagctaaccttagaacgacggaaaacacgtaaaagttntacgactaactaactttaacgttaccgaacggggacacgggtaagtaccgaaactttcaaacgtaccgaacccgtaacgtaaacgaaccaaccgtaacacccggaaacgaaccgacacccggttacaccccgttaacgacggtacgggtaaacctacgggaacggaaaacccgttgaacgttacctaccggtagaacccggtacgtaaacgtccgtttaaagttacctttagggtcggttaaacggacgaaagttaccggttaaactaacccgtttaccttaaaacccgtttaactaccgtaaacggttttaaccgaaacggttagttaacgggtactagggtttacctttttaacgg

SEQ ID NO: 436741 - DNA, 702 bp, Homo sapiens
  misc_feature: GZ8MTXP02FLG3M.38.25.C03.1.454.CMB.2.raw
  modified_base (390)..(390): a, c, t, g, unknown or other
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcttggttactacttttagctagttatggtgtcagcgtgggtgcgtacgacggcccccgtggaacgtaaggggtcttaggaggtggtaggtggggtagtgggactcgacgactacttaacaaagtacggaaaacaacgtaaaagttnacgacaactaacttaaacgtttaccggaggggtacagggtactacaagtaccgtaatacggaaaccaacgaaacgtaccaaactaacctaccgaaaccgtaacgcctaacgttcgacccttaacgaaacgtacggtaaacgtaggaaacgggaaccttagaacgtactacgacgaaccggaccgtaacggtacctttaattagtttagttacgacggacaaggtaaactaaacttaaacctttcccttaaacttaacctaacttaaaacgtccggtaaactaggttacggtaagttacgttactttttaacg

SEQ ID NO: 436742 - DNA, 818 bp, Homo sapiens
  misc_feature: GZ8MTXP02HKL4I.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggccgtggggcctcagtgaacgtctctgacaggtcttcgtggttactacttttagcgtagttagtggtgtcaggtcgtgggtgcgacgacggccccgtaggaacgaagggtcgttaggaggtggaaggtggggagtaggagttcgaaggtactaaaccgtttaaacgaaagttaaacggggaaaaaacctaacgaaaaaaggttagtaaccggtaacgtaaacctaaagtttaaaccttttacccgggaaggggttaaccaggtaaacggttactaacggttacctaacgttaacgaaacccaaacgaaaccgaaaccaaaccggtaaactacccgaaacggtaccgtaccaccgttcggaacccttaacacgggttaaacgggaaaacccgttgggaaacccggtaaaccggttaggacgggtaacttaaccggaacgggaaaccgtaaccggtaaccggttaacctttaaagtttaaacgtttaacggttggacgttaaccggggaaataaacggtaaaaccttaaacctttacccgtacctttaaacctaaagtttaaccgtaacgtaacggttaacgtagggtttaacttagtttaacgtttttaacg

SEQ ID NO: 436743 - DNA, 790 bp, Homo sapiens
  misc_feature: GZ8MTXP02FGGFE.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtcgcccactcccaggttcaattggtgcagtctggagctggcggtagaaggacggccgtggggcctcgaggtacgaaccggtcctccgtgacgaagggtctttacgttaggttaacctacgtttttacgaccgttaaggtttacgttggggtcgtaccgaggtcgtggggtcgccggaccgtaccgggcccccgtaggaccgaacggggtctttaggaggtggagtggggagtgggatcgacgtactaacgttacaaaggttacggaaaacaacgtaaaaggttcacgaccaataagtttaacttccggaaggggccagggtacgtacacttcgaacttacgaacctaaacgacgaaacaaccttacgacccagggacacaaccgtcgttacccaagacgtacggaaaccgtggaacggaccgttccgaggacggttactacccggtaggaacccgtaacggttaccggttacctttaattttaaccgttaaggtttcggacgggaaacgtaaacggtaaacctaaaccttaaaccttttacccccgggtaactttaaaacggttaactttaaacccgtttaaacgggaaacccgtttaggttaaagggtaaacctttcggtttttaaacccg

SEQ ID NO: 436744 - DNA, 760 bp, Homo sapiens
  misc_feature: GZ8MTXP02HR4MD.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaagttggtgcagtctggagctgcggtgaagaggcctgggcctcagtgaacgtctccgtgcaaggtcttcgtggttactacttttagctagttagtggtgtcgaggtcgtgggtcggcgacgaccgggtcccccgtagggaaccgtaaaggggtccgttaggtaggttgggtaaggttggggagtacgggattcgaacgtactaactttaaacgaaggttaaggaaaactaaccgaaaaggttactcgaaccgaaactaaagttaaaccggttttccggggaactaggtacggtctaaactctaacgggtaccaaccaacggaaacaacccttaaccaccgtccccgaaaaggccgaccaaccgttaccgacccttaacgtaaacgtacggtaaacgtacggtaaacgggaacccttaggaaaacgtcgtaccggttacgaaaccggaccgtacccggttacctttaattacgttaacgttggttacgaaccgtaggtaaactaaaccttaaacgtttcccctacgttaactacgttaacgtaacgacggtaatacgggtaatttcgttacctttagttttaaccg

SEQ ID NO: 436745 - DNA, 842 bp, Homo sapiens
  misc_feature: GZ8MTXP02IE4WZ.38.25.C03.1.454.CMB.2.raw
tcagtcgatcacgtcacgaccggtgctcgatttagtagtgtagatttgggtttgggggagctacaacaggcaggcaggggcagcaagatggtgttgcagacccaggtcttcatttctctgttgctctggatctctggtgccgtacgggacatcgtgatgacccagtctccagactccctggctgtgtctcgtgggcgaggacggccaccatcaactgacaagtccagccagtagttacgttttacactacggtacccaaactaaataagtaattacttcgtcgttacggtaaccagacaaacgaaaaccgacggaaccacggtcccttaccgttaaagtttacgccttaccttaattttaacgtcggggtacctacgttacccggtaaccccgggggacggtttacccccgggggtccccttacggacccggttaccgttaccgaccggggacccggtaccggacggggtacccggggttcgtacgggaacgaaacgtaacggttaacctttttacccgaacctttccttaaccctaaaccccagtaccctacggtacccgaccgtacccgttacggaccgtacggtaccgtaagtaaagggtagttacgggttacgggttaccgtttaaaggttttttaccgttaacgttcggtaccgtaaggtacgtttaatttaacgttttaagttaacggtaccttacgttaacccggtaggtttaccgggttttacgggggaaaccccgggtaaaccggtaaaggttaccgtaagggttaactaaaccgggtaaccgtaaaaaacggtccgttaggggttaccgaaccgtttcgaacccggtaaacg

SEQ ID NO: 436746 - DNA, 720 bp, Homo sapiens
  misc_feature: GZ8MTXP02FWA17.38.25.C03.1.454.CMB.2.raw
  modified_base (350)..(350): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctctgcaaggtcttctaggttactacttttagctagttagtggtgtcaggcgtgggtgcgacgcggcccctaggacgagggtctggagtggagtggggagtggatacgagctaacgttaanaagtacggaaaacaataaaagtatacgacctaactaagttaactttaccggaaggggactaggggacttacgtaagttaccagttaacgaacccaacaaacgaaccctaaacgactaacccgaacgaacgacccacgtacgtaccctaacgaacgtacggaaacgtaggtaaaccgggaaaccgtgaaacggttaactacgttaaccggaacggtaacccgtacgggttaaccctttaaagttaacgtttagtacggttacgacggtaaacgaaacgttaaacttaaacctttacccgttaacctaaacttaacgttaaacgttaaacgaacgtaggtaacggtaaacgttacggtttactttttaacgg

SEQ ID NO: 436747 - DNA, 635 bp, Homo sapiens
  misc_feature: GZ8MTXP02FSVDU.38.25.C03.1.454.CMB.2.raw
  modified_base (373)..(373): a, c, t, g, unknown or other
  modified_base (471)..(471): a, c, t, g, unknown or other
  modified_base (485)..(485): a, c, t, g, unknown or other
  modified_base (512)..(512): a, c, t, g, unknown or other
  modified_base (547)..(547): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggcttctggttactacttttagctagttagtggtgtcaggcgtagggtgcgtacgacgggcccctaggacgaagggtcttggaggtggagtgggagtggtatcgagctaacttacaagtagaaaccagaaagtntacgactaatattaacttccgaggctagacgtactagtactactacgaaccacaacgaccgacaacctacgactagaccaccgtacggaccccttaanacgtacgggtaaanccggaaaggtacccgtagaactacgtnaccggaacgaccgtacggttacttataacgttttnaggttacgacgaaagtacaaaacttaacttaccctaacgtactaacgtaagtaacgtacgaggtgtaaacggtcgttacttttaacgg

SEQ ID NO: 436748 - DNA, 668 bp, Homo sapiens
  misc_feature: GZ8MTXP02JZWIG.38.25.C03.1.454.CMB.2.raw
  modified_base (205)..(205): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagnggccgtggggcctcagtgaacgtctctgcaaggtcttcgtggttactattttagctagttatggtgtcgagtgtgggtgcgtacgacggcccctggacgaagggtcttggagtggagtgggatggatcgagtccaacttacaagtaggaaaacataaagtctaccgactaactattaaacgtttccgaaggggtacagtacgtacaacttacgaagtacgaaacccaacgaaacgtaaccaactaacccgtaccaaacggtacgacccttaacacggtaccccttaaaggaaccgttacgggaaaacgtacgggtaacgggtaaaaccctggggaacgtacgttacgaaccgaaccggaaccggtaccgtatttagtattttgacgtcgacgaagaaccgtaaactactttcctaacgttaatattaacgaacggtagacgttaggactttcgtaacttttcg

SEQ ID NO: 436749 - DNA, 751 bp, Homo sapiens
  misc_feature: GZ8MTXP02HYJZH.38.25.C03.1.454.CMB.2.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggtcttctggttactactttttagctagttatggtgtcgagctgggtgcgacgacggcccctggaccgtaagggcgttggagtggagtgggatggatcagcagttacaagtaggaaaacaacgaaagttatacggactaacgtaattaaacgtttcccgaaggggactaggaacgttacacttacaagtcgaaaccaaacacgaaaccacgaactccaacgaagccaaccgttcgaccccttaaacgacgtacggtaaacccgttggaaaaccgggtaacccgttaggtaacgtaaccgtttacggtacggaaaaccccggaacgtaacccgggtttaacctttaaacggtttaattttaaggttttaacgggttccgggaaaagttaacgggtaaaacggttaaaccttaaaaacgttttcccgtaaacccttttaaacaccggttttaaacgtaaacccgggtaaataaaccggttagggttaaaccgggttctttaaaacccggtttttc

SEQ ID NO: 436750 - DNA, 578 bp, Homo sapiens
  misc_feature: GZ8MTXP02IKWY1.38.25.C03.1.454.CMB.2.raw
  modified_base (393)..(393): a, c, t, g, unknown or other
  modified_base (521)..(521): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacactttttagcagttatggtgtcagctgggtgcgacaggcccctggacaagggctgagtggatgggatggatcagcacttacaataggaaacacaaaagtatagacacaataatttccagggcagagtacatacatgaccaacanacacatccagagcactgcctacatggaaactgaagacctagagactactacgaacgacgacggtacttaattaactttagttcgtaggtacgaagaacgtaaaccaaaactttccctaaccctttaanaaacttaacgtttaacccgacgttaaacgtaggtaaacgtttaggtactttttaacg

SEQ ID NO: 436751 - DNA, 649 bp, Homo sapiens
  misc_feature: GZ8MTXP02FGSCC.38.25.C03.1.454.CMB.2.raw
  modified_base (434)..(434): a, c, t, g, unknown or other
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggcctggggcctcagtgaacgtctcctgcaaggcttcgtggttactacttttagctagttagtggtgtcagcgtgggtgcgacgacggcccctggacaagggtcttggagtggagtgggatggatcgagcacttaacaagtaggaaacaacgaaagtatacgacaacgtaattaaacgtttacccgaggggttacaggtaacgtctaagttacaatacgaacccaanaacgtaaccaacacgtaccacgacggaccaacgtcaacccttacgaagtacgggaaactggaaaccgtaaccgtagaacgtaacgttacgacgaaccgtactaacgggttaccttaataacgtttagtacggtagacggataaacggtaccttaaaacgttcccttaacgtactaactaagttaaccgacgtatacggtatccgtatttttaacg

SEQ ID NO: 436752 - DNA, 641 bp, Homo sapiens
  misc_feature: GZ8MTXP02GEBYL.38.25.C03.1.454.CMB.2.raw
tcagtcgatcacgtcacgaccggtgctcgatttagtagtgtagatttgggtttggggacccaaaaaccacacccctccttgggagaatctcctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagctgggtgcgacacggcccctggacaagggctggagtggatgggatggatcagctacttacgaaataggaaaacacaaaagtatagacaacaattaaactttccgaaggggtccaaagtacgtacaatcaatcgaaaccacacgaaccacaactaccgaaacgacgaccgaactcgacctaaacagttacggaaaaccttggaaacggtaaaccgtggaaactgtaccgtaggaaaccggtaacaccgggtaccctttaaagtatttaaacgttggacgtaacgggataaacggaaacttaaccgttacctaccgtttaaacaacgttaaaactttaccgggactaaggtacggtaaagtcgtttaacc

SEQ ID NO: 436753 - DNA, 768 bp, Homo sapiens
  misc_feature: GZ8MTXP02IE176.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctggtgcgacaggcccctggacgaagggctgagtggagtgggatggatcgagcacttacaagtaggaaaacacaaagtatacgacaacgtaataaactttccgaagggtaccaggtacgtactaacgtactaacttacggaaccaacgaaacgaccaaccaacgtacccgaaccgaacgaccaaccgtacggtacccctaaacgtaacgttacgggaaacgttaccgggaaacggggtaaaaccccgtgggtaaacggtaacgtttacccggtaaacggtaacccggaacccggtaacccggggttaaccctttaaaggtttaaacttttaagtttcgggttacgggtaaaccggtaggtaaacggttaaaccgttaaaaaccttttcccccgttaaaaccgtttaaaccgttaaactttaaacggttaaaacccggtaaaccggttaaacggttaagggtaaaccgggtttacttaccgtttttttaaaccgg

SEQ ID NO: 436754 - DNA, 615 bp, Homo sapiens
  misc_feature: GZ8MTXP02GM4WO.38.25.C03.1.454.CMB.2.raw
  modified_base (220)..(220): a, c, t, g, unknown or other
  modified_base (403)..(403): a, c, t, g, unknown or other
  modified_base (408)..(408): a, c, t, g, unknown or other
  modified_base (418)..(418): a, c, t, g, unknown or other
  modified_base (443)..(443): a, c, t, g, unknown or other
  modified_base (452)..(452): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggccgtggggcctnagtgaacgtctcctgcaaggtctttcgtggttactacgttttagctagttacgtggtgtcagtcgtagggtgacggacgacggcccgtaggacgaacggtcttaggagtggagtgggatggactcgagacgtacttaagaagtacgaaacagtaaagtactgacactaatacttcgaggcagnactancatcgaccanagacacgtacaccgagacgtacacncgaacctanagtacggtaaactggaacgtacgtagcgtacgtacgtacgaacgacggtacgtacttaagttagttagttcgacggtagaacgtaacgtaaacctacgttcctttaaccgtactaaattaagttaccgaaacggtagtacgggttaatcgtttaacttttacg

SEQ ID NO: 436755 - DNA, 781 bp, Homo sapiens
  misc_feature: GZ8MTXP02FPJCO.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtagaaggaggccgtggggcctcagtgaacgtctcctgcaaggcttctggttactacttttagctagttatggtgtcagtcgtgggtgcgacaccggcccgtaggaacgaagggcttaggaggtggagtggggatggatcgacggactaacttaacaagtaacggaaaaccaaagtaaaaggtatcgaactaacgaaattaaacgtttaccggaacggggtacagggtacgtaactaaactaccgtaagtaaccgaaacccgtaaacgaaacggaaccaaaaccctaacggtaaacccaaccggggaaacgtaccgaacccttacggaaaccccctaacggtaaaggttacggaaaaccggtttaacgggaaacggtaaaacccgtggtttaaacgaaacgttaccgtaaccggaaacggacgtaacccgggttaactttaaacgttaaactttaacgggttaggtaaccggaggtaaaacgtaacggtaaaaccttaaacctttaccctaacgtttaaactaacttaaaacggttacgaaacggtaacgttaaagggtacgttacggtttactttttaacgg

SEQ ID NO: 436756 - DNA, 573 bp, Homo sapiens
  misc_feature: GZ8MTXP02GDV8W.38.25.C03.1.454.CMB.2.raw
  modified_base (275)..(275): a, c, t, g, unknown or other
  modified_base (334)..(334): a, c, t, g, unknown or other
  modified_base (360)..(360): a, c, t, g, unknown or other
  modified_base (373)..(373): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcngggtgcgacaggcccctggacaaggggcttgagtggatgggatggatcaggcaacttanaatggaaaacacaaaagtatacgcanataattccaggcngagtcaatcatagacacagacacgatccagagacactgcctacagtgaaacgtgaaggaacccgtagagtaactctagaacgacgtaacgggcttaacttacttaattcgttaggaccgaagtacgaaactaaaacttcctaaccttaacattaaacgttaacgaaaccgtacgtaggtaacgtaggttacttttaaccg

SEQ ID NO: 436757 - DNA, 646 bp, Homo sapiens
  misc_feature: GZ8MTXP02G1H09.38.25.C03.1.454.CMB.2.raw
  modified_base (448)..(448): a, c, t, g, unknown or other
tcagtcgatcacgtcacgaccggtgctcgatttagtagtgtagatttgggtttggggacccaaaaaccacacccctctttgggagaatcccctagatcacagctcctcaccatggactggacctggagcatccttttcttggtggcagcagcaacaggtgcccactcccaggttcaattggtgcagtctggagctgcggtgaaggacggccgtggggcctcgagtacgaacgtctccgtgcgaaggtcttcgttaggttactacgtttagactagtttagtggtgtcaggtcgtgggtcgacgacgacggccccgtaggaacgaggtcttggagtggaggtggagtaggactcgtacgctaacttacgaagtacggaaaacaactaaagtagacgacaataagttaacgtttacggaggtcaggatcgtaacgtagatacgaaccaanaacgactaccacgtaaccgacgataccaccacgtacctacagacgaacgtagtaacggactaaggtactagttacgacgaccgtaaccgacgttacttattacttagtgacggtagaactacgaaccttacgtaccttaacgtaactacgtaaacgttacgaagttacggtacgtttaagtacgttagtttttaaccg

SEQ ID NO: 436758 - DNA, 660 bp, Homo sapiens
  misc_feature: GZ8MTXP02FOW9M.38.25.C03.1.454.CMB.2.raw
  modified_base (448)..(448): a, c, t, g, unknown or other
  modified_base (477)..(477): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatcctttcttggttggcagcagcaacaggtgcccactcccaggttcaattggtgcagtctggagctgcggtgaaggaggccgtggggcctcagtgaacgtctcctgacaaggtcttctggttactacttttagctagttagtggtgtacgagcgtgggtgcgacgacggcccctaggacgagggcttaggagttaggagttgggatggtactcaacgtctaaacccgttaagaaagttacggaaaacaaacgtaaagttaagaccgaacaacctaaagtaactttaccgagggtcagagtaccatacagacgaccaaanacgacacacacgacgacacacacaactanacgtacgaactaacggacgtacgagaatacgtacgtaacgaaccgtaccgacgttaacttaagtaacgttagtacgtacggacggaaacgtaaacgtaaaaccttaacgtttacctaaaccgttaataaacgttaaagttaacgtaaacgtaaacgtaacggttaacttacgtttactttacg

SEQ ID NO: 436759 - DNA, 679 bp, Homo sapiens
  misc_feature: GZ8MTXP02GGOQU.38.25.C03.1.454.CMB.2.raw
  modified_base (351)..(351): a, c, t, g, unknown or other
  modified_base (372)..(372): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagcgtgcggtgaagaggccgtggggcctcagtgaacgtctcctgcaaggcttctggttactactttttaggctagttagtggtagtcaggcgtgggtgcgaacgcggcccctggacgaagggtctaggaggtaggagtgggatggatcgagctaacttanaagtggaaaacactaaagtancgtacacgtaattaacttccgaagggaccaggtactaccgaatctaagtaccgaaaccactaacgaaacaaccaacgtaccaacgagacctaacggttcgaacccgtaaatacgtaacggtaaacgtacggaaacgtaaccgtagaacgtacgtaccgaacgaaccgtaccgttaaccgttacttaagttaacgttagttacggtacgtacggtaaagtaaaccgtaaacttaaactttaccccttaacgttacgtaaacttaaacgtaacgtacgttaacgtaacgtacgttacgtttactttacg

SEQ ID NO: 436760 - DNA, 683 bp, Homo sapiens
  misc_feature: GZ8MTXP02JWQPS.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctggcggtgaagaggccgtggggcctcagtgaacgtctcctgcgaaggtcttcgttaggttactacttttagcttagttagtggtgtcgaggtcgtgggtgcgacgacggccccgtggacgaagggtcttggagtggagtgggatggatcgagactaacttaagaagtacgaaaacgtaacaaagtatacgactaaagtaacgttaactttacggaagggacagggtaactacgtaattaccgaagtaccgaaaccaaacaacgaaacccaaaccaacgtacgaacgacgacctacgtacactaacagtacggaaacgtacggaacgggtacaagatacgttacgacgaaacgaccgttaacggttacttaaagttagttacgttagtacggacgtaagtaacgtaaacttaaaccttcccttacgttaaacctaaggtttaaacctaacggaacgttacggtaggttaacgttcgtttaactttttacg

SEQ ID NO: 436761 - DNA, 743 bp, Homo sapiens
  misc_feature: GZ8MTXP02F8HP0.38.25.C03.1.454.CMB.2.raw
  modified_base (278)..(278): a, c, t, g, unknown or other
  modified_base (337)..(337): a, c, t, g, unknown or other
  modified_base (624)..(624): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcattccttttcttggtggcagcagcaacaggtgcccactcccaggttcaattggtgcagtctggagctggcggtgaaggaggccgtggggcctcgagtgaacgtctcctgcaaggtcttcgtggttactacttttagctagttagtggtntcagtcgtggtcgacgacgaccggcccgtaggacggacgggtcgttaggaggttagggnggtagggtacgtaggacgtacgaacgtactaacgttaacgaaaggtaaacggaaaaccgtaaacgtaaaacgtagtacccgaacgtaaactaactttaaccgttaaccggaaggggtaccagggtacttactaaagtcgtaacaccgaaaccaacgtaaacgactaaccacgtacgaaccggacaccacgttcaaaccttgaaacgcgtaaacgaggaacgtaacgagacgtacttacggaacgtaacctaaccggaacggtttactttaaaggtatttttaacggnggtacggtaaacgaacggtaaacgttaaaaccctttaaactttccccttaaattaacgtaacgttaaacggttaaccggaactaagggttacgtaactttacggtttctttttaaaccg

SEQ ID NO: 436762 - DNA, 731 bp, Homo sapiens
  misc_feature: GZ8MTXP02GDDV1.38.25.C03.1.454.CMB.2.raw
  modified_base (288)..(288): a, c, t, g, unknown or other
  modified_base (387)..(387): a, c, t, g, unknown or other
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggcctcagtgaacgtctcctgctaaggcttcgtggttactacgtttttagctagttatggtacgtcagcgtgggtcncgacaggtccccctaggaccgaaggggtcttggaggtggagtggattaggctgagctaacttagaataggaaaacaacgtaaagtactaggacctaaanaactttaaacgtttacccgaaacggggttacgacggtaccgtactaacttacaacgtacgaaacccaaacgaaacgtaaaccaaccgtaacgaacccgtaaacggacgtaacccacgtacgtaaccgtaacgtaacgttacgggtaaaaccggtacggtaaaccggtaacgtaaggaagtacgtaccgtaacggaaccgtaacgtacgttaacgttaagtttaagttacgttaggtacggtacggtaagtaaacgttaaaccgtaaactttaccccttaacttaaacgtaacttaacgttaaccgtaacggtaacgttaggtaacgtttcgttaacttttaacg

SEQ ID NO: 436763 - DNA, 762 bp, Homo sapiens
  misc_feature: GZ8MTXP02H7I7B.38.25.C03.1.454.CMB.2.raw
  modified_base (239)..(239): a, c, t, g, unknown or other
  modified_base (620)..(620): a, c, t, g, unknown or other
tcagtcgatcacgtcacgaccggtgctcgatttagtagtgtagatttgggtttgggggacccaaaaaccacacccctcccttgggagaatccccctagatcacagctcctcaccatggactggacctggagcatccttttcttggtggcagcagcaacaggtgcccactccccaggttcaagttggtgcagtctggagctgcggtgaaggaggcctggggcctcaggtgaacgtctccngacaaggccttacgtggttaactacttttagcctagttagtcgggtgtaccaggtcgtgggtacgacgacacggcccccgtaggaccgaaggcttggaacggtggagttgggaattcggatacgacggtactaagtttaacgaaagtaggaaaactacgaaaggtactgacctaacgtataaacgtttccggaggaccagtacgttacaagttacagtaccgacaaacgacgttaaccaactataccccgaagtagacccgtagttccgaaccgtaaaccttagtaaacccggaaagttcgggaaaccggtaaaccgtttagggaaatacccggtaccgttaagggaaaccccgaaacgtttacccgggaaccttttaaanacccgttttaacgtaggttacgggaaacccgtaaagggtaaacgtaaacctttaaaacccggttccccttaaccggttaaaacaacgttaaaccgtttacgaaaacccggtacttaaggggaactttcggtactttttaacg

SEQ ID NO: 436764 - DNA, 787 bp, Homo sapiens
  misc_feature: GZ8MTXP02FHU4M.38.25.C03.1.454.CMB.2.raw
tcagtcgatcacgtcacgaccggtgctcgatttagtagtgtagatttgggtttggggacccaaaaaaccacacccctccttgggagaatcccctagatcacagctcctcaccatggactggacctggagcatccttttcttggtggcagcagcaacaggtcgcccactcccaggttcaattggtgcagtctggagctgcggtgaagaggccgtgggcctgagtgaacgtctccgtgcaaggtcttcgttggttactacttttagctagttagtggtgttcgagtcgtggggtcgacggtacgaccgggtccccgtagggaacgaacggggtcttagggtagggtgggaaggtggggtaatgggtaactcgaacgtcgtaaacttaacgaaaggttaacgggaaaaccaaacgtaaaacgtttacgaccggaacctaaacctaaagtttaaaccgtttacccggaacggggttacgtacggtacgtactaaacgttaccgtaagttaaccgaaaccgaaacgaaacgtaaacgaaacctaacccgtaccgaacgggaactacccgtaacgttaccggaaccctttaaacgacgttaacgggtaaacggttacggaaaacgggttaacccgttaggaacgtacgtacggtaaccggtacaaccggttaaccggtacgtttaatacgtttacgtggtacggacgaaagtaacgtaaaccttaaccttacctaacctagttaaacgtaacgtaacggtaagtcgttaaagggtacttgttactttttaacg

SEQ ID NO: 436765 - DNA, 723 bp, Homo sapiens
  misc_feature: GZ8MTXP02IGQWQ.38.25.C03.1.454.CMB.2.raw
  modified_base (302)..(302): a, c, t, g, unknown or other
  modified_base (317)..(317): a, c, t, g, unknown or other
tcagtcgatcacgtcacgaccggtgctcgatttagtagtgtagatttgggtttgggggagctacaacaggcaggcagggcagcaagatggtgttgcagacccaggtcttcatttctctgttgctctggatctctggtgcctacgggacatcgtgatgaccagtctcagactcctggctgtgtctcgtggcgagaggccacatcaactgcaagtccagcagagttgttacactaggtaccaacaataagattctcgacttaggaccagctaagaaaccgaggacacgtaccctactaacgttnactcctaatttacgngggccaaagtttccgggtaaccccgggacggttccccgggggttacccctcgggaacccggttaacgtttccgaaggggcccgggtcgaacggggtccgggttctaggaacgaaacgtaggttaccttttaccacgttcctaccgaaccttacaccgtacgacgacgccgtcgacgaacggttacgtaagaacggtagtacggttcggtaaccgttaggttttaacgttaaccgttagtaacccgtacgtacgttaaacggttaacttaagttaaccgttacgtaccgttaccgttaacggttaaccggttttcgggggaaaccgggttaaccgaaacggtacgtaccggtaaagacgtaaccgtaaacgtaaaacgtcggtacgtaccggtctaccggttaaccg

SEQ ID NO: 436766 - DNA, 844 bp, Homo sapiens
  misc_feature: GZ8MTXP02FPT4F.38.25.C03.1.454.CMB.2.raw
tcagtcgatcacgtcacgaccggtgctcgatttagtagtgtagatttgggtttgggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtacgaacgtctccgtgcaaggcttctggttacacttttagctagttatggtgttcagtcgtgggttgacgtacgacggcccctaggacgaaggggtcctttaggaggtggagtaggggtatcggggatcgaacggtcctaaacgtttaaccgaaaggttacgggaaaacctaacgtaaaaggtacggttaccgaaccgtaacctaaaagtttaaacgtttcccggaaaacggggttcgaagggtacggtacccttaaagtccgtaaagttccgaaacccgaaagtaaacgaaaccaacccggttaaccaacccggaaacggttaacccggacctaacccgtttacggaacccttacccggtaaagtaacggggaaaccttacggggaaaccggttaaaacccggtaggtaaaccgttaccgttaaccgtaccgggtaaacccgtaacccggttaaccggtttaaccgtttaaagtttaacggtttagtaaccgggttaacggtaaaccggtaaagtaaaccgttaaaacttaaacccgtttaccttaaacccgtttaaccgtaacgttaaacgttacggaaaccggtttaggttaacggtaacgtttacgttacgttttacg

SEQ ID NO: 436767 - DNA, 674 bp, Homo sapiens
  misc_feature: GZ8MTXP02FNDR9.38.25.C03.1.454.CMB.2.raw
  modified_base (209)..(209): a, c, t, g, unknown or other
  modified_base (338)..(338): a, c, t, g, unknown or other
  modified_base (348)..(348): a, c, t, g, unknown or other
  modified_base (405)..(405): a, c, t, g, unknown or other
  modified_base (414)..(414): a, c, t, g, unknown or other
  modified_base (427)..(427): a, c, t, g, unknown or other
tcagtcgatcacgtcacgaccggtgctcgatttagtagtgtagatttgggtttgggggacccaaaaaaccacacccctccttgggagaatcccctagatcacagctcctcaccatggactggacctggagcatccttttcttggtggcagcagcaacaggtgcccaactcccaggttcaattggtgcagtctggagcgtgcggtgaagnggccgtggggacctcagtgaacgtctcctgcgaaggcttctggttactacttttagcgtagttatagggtgtcagcgtgggtgcgacaggccctaggacagggctggagtgagtgggatggatacagtnaacgtttaanaacgttaggaaaaccaagtaaaagttagacgtacaataaagtactttaccgaggganagtacgtanacatatacaacanacaacacactacacgagacacgtacaccaagtaagtacggtaaactaggaaacggtaacgtagaacgtaactacgaacgtaaccgaccggtacgtttaacttaagttaacgtttagttacggtacggtaacgtaaacggtaaacgttaaaacccgtaaactttacccttaaacgttaacgttaaaacgttaaacggttaaacgaacggttacgttacggtaaaagtttaccgtttaacgtttttaac

SEQ ID NO: 436768 - DNA, 804 bp, Homo sapiens
  misc_feature: GZ8MTXP02GQB99.38.25.C03.1.454.CMB.2.raw
tcagtcgatcacgtcacgaccggtgctcgatttagtagtgtagatttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactacttttagctagttagtggtgtcagtcgtgggtgcgtacgacggtccccgtaggacgaacgggtctaggacggtaggagtagggagtggatcgtagcgtaacttacgaagtacggtaaaacaacgtaaagtataccgacgtaactaacgttaaactttacccgaagggtacagggtacgtacgtaaatacgagttacgaaccaacaaacgaacaccacgtaccgaacgaacgtaccaaaccgttcggaacccctaaagtacgtaaacgggtaaaacccgtacgggtaaaacggtaaacccggttagaaccgggttaaacgtaccgtaaccggtaaaccgtaaccgggtaacccgggttaacctttaaagtttaaccgtttaagttacggtaaaaccggttacggggaaaactaaaaccgggtaaaactttaaaacccgtttacccgtaaacccgttttaaactaaacgtttaaaccggtttaaaacccggtaaacggttaaaggtaacgggtttaaacggtttaacggtttacccttttttttaaaaccggg

SEQ ID NO: 436769 - DNA, 538 bp, Homo sapiens
  misc_feature: GZ8MTXP01AMUHL.51.2.A02.1.454.CMB.2.raw
  modified_base (433)..(433): a, c, t, g, unknown or other
  modified_base (516)..(516): a, c, t, g, unknown or other
  modified_base (532)..(532): a, c, t, g, unknown or other
tcagcgatcgtatacacgaccggtgctcgatttagactcatctacagggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtggggaaacaacattggaagtaaaactgtgcactggtaccagcagaagccaggccaggcccctgtgctggtcgtctatgatgatcggcccgaccggcccctcgacggggactcccccgtggaaaccgtatttcctctggcctccccaggctctgagaaaaccaccgggcccaccctgagccatcagcgaggggtcgaaggccggggatggaggccgatattacgngtcagggtgtgggattacgtagtagtagatcatgtcttcggaccgtggaccaggtcaccgttcagcagcccaggcccaacccntcgcactcttcgtccnccctcc

SEQ ID NO: 436770 - DNA, 571 bp, Homo sapiens
  misc_feature: GZ8MTXP01D2ZAN.51.2.A02.1.454.CMB.2.raw
  modified_base (277)..(277): a, c, t, g, unknown or other
  modified_base (311)..(311): a, c, t, g, unknown or other
  modified_base (334)..(334): a, c, t, g, unknown or other
  modified_base (545)..(545): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtgggggaaacaacattaggaagtaaaactgtgcactggtaccagcagaagccaggccaggcccctgngctggtcgtctatgatgatcgcccgaccgccctnagggactcccctagaacgattcnctggcctcccagctctgacgaaacaccgggcccaaccctgacgcaatcgagcgaggggtacgaaagggccgggggaatggaacggacccgtaacttaatacgtgtcgaagggtgtagggatacgtagtagtgaatcagtgtcgttcggaccgtgggaaccaagggtccaaccgttcgtaaggttccacgacccaacggccccaaacccctntcgtcactcttcgtccccgccctccc

SEQ ID NO: 436771 - DNA, 561 bp, Homo sapiens
  misc_feature: GZ8MTXP01D6UQR.51.2.A02.1.454.CMB.2.raw
  modified_base (362)..(362): a, c, t, g, unknown or other
  modified_base (534)..(534): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtggggaaacaacattggaaagtaaaactgtgcactggtaccagcagaagccaggccaggcccctgtgctggtcgtctatgatgatgcccgaccggccctacgaggggactcccctgaacgtattctcgtggcctcccagctctgacgaaacncggccaaccctgacgcaatcagcaggggtcgaaaggccgggggataggaggacccgtaacttaagttaccgtggtcaagggttgtagggtaatacgtaggtagtgatcattgtacttcggacctgggaaccagggtcaccggttccaggttcacgcccaaaggcccaacccntcgtcactcttcttccccaaccttccc

SEQ ID NO: 436772 - DNA, 692 bp, Homo sapiens
  misc_feature: GZ8MTXP01EFFJ7.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattaccgtggtagggggaaacaacattaggaaagtaaaactgtgcactggtaccagcagagcaggccaggcccctgtgctggtcgtctatgatgatcggcccgacccggccctacgacgggtactccccgtaggaaccgtatttccgtcgtcggccttccccgaggtcctcgtagaacgaaaacccgacccgggccccaccccgtgggaaccgcacgtcgacgggaccggtacgggggtacggaaacggggccgggggtagtacgggaaccgggtacccgtaacgtttacgttacgtcggtacggtagggttggtagggtaacgttacgttaggttagtagtacttcgtagtttcggttaccgttccgggtaccggtacgggaacccgtaacggtcccgtaacccggttcgtacggttaccgaaccgaccccgaaaccggccccaaacccctcgtcgtccctccgtccgttcccgttccccgttcccttcg

SEQ ID NO: 436773 - DNA, 651 bp, Homo sapiens
  misc_feature: GZ8MTXP01CWT5P.51.2.A02.1.454.CMB.2.raw
  modified_base (207)..(207): a, c, t, g, unknown or other
  modified_base (221)..(221): a, c, t, g, unknown or other
  modified_base (274)..(274): a, c, t, g, unknown or other
  modified_base (277)..(277): a, c, t, g, unknown or other
  modified_base (284)..(284): a, c, t, g, unknown or other
  modified_base (287)..(287): a, c, t, g, unknown or other
  modified_base (294)..(294): a, c, t, g, unknown or other
  modified_base (323)..(323): a, c, t, g, unknown or other
  modified_base (327)..(327): a, c, t, g, unknown or other
tcagcgatcgtatacacgaccggtgctcgatttagactcatctacagggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattaccngtaggggaaacaanattggaaagtaaaactgtgcactggtaaccagcagaagccaggccaggccccngtnctggctntangatgacncgccgaccgccagaggactccagaacgtnttcncgtgcctacccgagtctctagaacgaaacgaaccgcccacccgtacgacgacactacgacgacgacgggtacggaacgggacggggacggtacggacggaccgtaacgttaacgttacgtacggtacgtagggtagggtagggtaacgggttaacgttaaggtaaggtagtagtacgtagttacggttaccgttaccggtaccggtaccgggaaccggtaaacggtaaccgtacccgttaccgtacggttacgaaccgaacccgaaccggacccgaaccccgaacctacgtcctacctccgttccgttcccgttccccgtcccg

SEQ ID NO: 436774 - DNA, 614 bp, Homo sapiens
  misc_feature: GZ8MTXP01CSGSA.51.2.A02.1.454.CMB.2.raw
  modified_base (505)..(505): a, c, t, g, unknown or other
  modified_base (582)..(582): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtagggggaaacaacattaggaaagtaaaactgtgcactggtaccagcagaagcaggccaggcccctgtgctggtcgtctatgatgatcgcccgaccgccctacgagggactcccgtagaacgattctctggcctccccgagtctctaggaacgaaaaccacccgggcccaaccccgtggaaacgccaagtccgaggaccgaagggggtaccgaaaacgggcccgggggaatacggaacgggacccgtaaccttaattaccgtgtacgtaagggtggtgggaatacgttaagtagngatcagtgtaccgttcggacctagggaccaagggtcaacccgttcgtacggcaacgcccaacggcccaaaccccgtnacgtcaccgtcttccgttccccgcccttcccg

SEQ ID NO: 436775 - DNA, 640 bp, Homo sapiens
  misc_feature: GZ8MTXP01BID05.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtagggggaaacaacattaggaaagtaaaactgtgcactggtaccagcagaagccaggccaggcccctgtgctggtcgtctatgatgatcgccgacccggccctcgagggactccccgtagaacgtattctctggctccccagctctagacgaaaccaccggccaccctgacgcatcaggcgaggggtacgaaggccgggggatgggacggaccgtacttattacgtgtacgagggttgtaggggaatacgttaaggtagtaggtaactcgtagttcggttaccgttccggggaaccgttacggggaaaccctaaacggggtccctaacccggttaccgtacgggttccaaccggaccccgaaacgggttccccaaaccccgtaacgtcgtaacccaccgttcccttcccgttcccccaaccccgttcccg

SEQ ID NO: 436776 - DNA, 528 bp, Homo sapiens
  misc_feature: GZ8MTXP01B0FGH.51.2.A02.1.454.CMB.2.raw
  modified_base (355)..(355): a, c, t, g, unknown or other
  modified_base (417)..(417): a, c, t, g, unknown or other
  modified_base (443)..(443): a, c, t, g, unknown or other
  modified_base (504)..(504): a, c, t, g, unknown or other
  modified_base (523)..(523): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatcgccgaccggccctcgagggactccctgaacgtattctctggctcccagctctgagaaacnccggccaccctgacgcatcagcgaggggtcgaaggccggggatggacggccgactattacgngtcgaggtgtgggatacgtaggtagngatcattgtcgttcggccgtggaccaaggtccacgttctaggcacgcccaggcccaacccntcgcactcttcgttccccncctcc

SEQ ID NO: 436777 - DNA, 565 bp, Homo sapiens
  misc_feature: GZ8MTXP01EWXCF.51.2.A02.1.454.CMB.2.raw
  modified_base (537)..(537): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattaggaaagtaaaactgtgcactggtaccagcagaagccaggccaggcccctgtgctggtcgtctatgatgatcgcccgaccggccctcgaggggactccccgtagaaccgtattcctcgtggcctccccagctcgtgaacgaaaccaccggcccaccctgacgcaatcgagcgagggtcgaaggccggggatggacggaccgaacttatactgtacgagggtgtagggatacgtaggtagtgatcgattgtcgtcggtaccgtgggaaccagggtccaccggttctaggttcacgcccaacggcccaacccgntcgtcactcttcgttccccgccctcccg

SEQ ID NO: 436778 - DNA, 535 bp, Homo sapiens
  misc_feature: GZ8MTXP01BCZ8C.51.2.A02.1.454.CMB.2.raw
  modified_base (319)..(319): a, c, t, g, unknown or other
  modified_base (374)..(374): a, c, t, g, unknown or other
  modified_base (510)..(510): a, c, t, g, unknown or other
  modified_base (529)..(529): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtgccccaggacagacggccaggattacctggtagggggaaacaacattaggaaagtaaaactgtgcactggtaccagcagagcaggccagcccctgtgctggcgtctatgatgatcgccgaccgccctgagggactcccgngaacgtattctcgtggcctcccgagctcgtgagaaaccaccggcccaccctgacncatcagcgagggtcgaaggccggggataggacggacccgtaacttagttaccgtggtacgagggtgtagggtatacgtagtagtgatcatgtctcggactggacaggtcacgttctaggcacgccagcccaacccngtctcactcttacgtcccnccctcg

SEQ ID NO: 436779 - DNA, 526 bp, Homo sapiens
  misc_feature: GZ8MTXP01BQ1EN.51.2.A02.1.454.CMB.2.raw
  modified_base (404)..(404): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtggggaaacaacattggaagtaaactgtgcactggtaccagcagaagccaggccaggcccctgtgctggtcgtctatgatgatgccgaccggccctcagggatcccctgaacgattctctggctcccagctctgagaaacacggccaccctgacgcatcagcagggtcgaaggccgggatgaggccgatattacngtcaggtgtgggatactaggtagtgatcgatgtacttcgaccgtggaccaggtcaccgttctaggttcagcccaacggcccaaccccgtaatcgtccactccttcgttccccgcccgttccc

SEQ ID NO: 436780 - DNA, 636 bp, Homo sapiens
  misc_feature: GZ8MTXP01BZETE.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtcggccccaggacagacggccaggattaccgtggtagggggaaacaacagttaggaaagtaaaactgtgcactggtaccagcagagcaggccagcccctgtgctggtcgtctagtgatgatcgcccgaccggcccctcgagggactcccgtagaaccgtattcctcgtcggcctccccgagtctcgtacggaacgaaaaccaccgggcccaacccgtggaacgcatcgagcgaggggtacgaacgggccggggatcggaggaccgtattacttacgtgtcgtaagggtggtagggacttaacgtaggtaagtgtaatcgagttcggtaccgttcggtaccgtacgggaaccgtaagggtccctaaccggttcctagggttcccaacggaccccgaacggccccaaaccccgtgtaccgtaacctacctccgttaccgttcccccttaacccgttcccg

SEQ ID NO: 436781 - DNA, 663 bp, Homo sapiens
  misc_feature: GZ8MTXP01DTZ5P.51.2.A02.1.454.CMB.2.raw
  modified_base (632)..(632): a, c, t, g, unknown or other
  modified_base (655)..(655): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtcggccccaggacagacggccaggattaccgtggtaggggaaacaacagttaggaaagtaaactgtgcactggtacagcagagcaggccacggcccctgtgctggtcgtctatgatgatcgcccggaccccggccctacgacggggtactccccgtagaacgtatttcctcgtcggccttcccaggtctcgtagaacgaaaacccgacccgggcccaccccgtggaacgacctacgtcgaacgggcggtaaacgggggccggaaacggggcccggggggaattacgggaacgggtacccggtaactttaagtttaaccgtggtaccgtaagggttggtaggggtaattaacggttagttaaggtgtatcgtagttcgttaccgttcggtaccgtaggggaacctaagggtccaccggttcgtagggttcacgcccgaacggcccaaaccccgtntcgtctaccgtcttccttccccncccttccg

SEQ ID NO: 436782 - DNA, 623 bp, Homo sapiens
  misc_feature: GZ8MTXP01B9OA1.51.2.A02.1.454.CMB.2.raw
  modified_base (357)..(357): a, c, t, g, unknown or other
  modified_base (361)..(361): a, c, t, g, unknown or other
  modified_base (411)..(411): a, c, t, g, unknown or other
  modified_base (464)..(464): a, c, t, g, unknown or other
  modified_base (587)..(587): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcacgccaccctcggtgtcggtcggccccaggacaggacggccaggattaccgtggtagggggaaaacaacagttaggaaagtaaaactgtgacacgtggtaaccagacaaggaacgccgaggcccacggcccctgtcgcgtggtcgtctatgatgagtcgcccgacccggccctagacgggtactcccgtagaacgtnttcncgtcggcctcccgagtctcgtagaacgaaaccaccggcccaccgtggacncatcgagcgagggtacgaacggccgggatcggacggaccgtactacgttacgngtacgtagggtgtagggtaacttacggtaaggtagtgatcgagttcggttaccgtcggaccgtacgggaacctaggtcctaccggttcgtacgccgaaccgcccgaaccggcccaaaccccgntcgtcctaccttccgttcctcccccttccgttcccg

SEQ ID NO: 436783 - DNA, 618 bp, Homo sapiens
  misc_feature: GZ8MTXP01A9C00.51.2.A02.1.454.CMB.2.raw
  modified_base (277)..(277): a, c, t, g, unknown or other
tcagcgatcgtatacacgaccggtgctcgatttagactcatctacaggggctgggcctaaggaagtagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtagggggaaacaacattaggaaagtaaaactgtgcactggtaccagcagaagccaggccaggccccngtgctggtcgtctatgatgatcgcccgaccggccctcgagggactccccgtagaacgtattcctcgtcggctccgagcctctgagaaccaacgggcccaaccctgacgcatcgagcgaggggtcgaaggccggggatggacggccgtacttattactgtcgagggtgtagggatacggtagtagtgatctagtcgttcgttacgggctacgggggaacctaacgggttccaaccggttccgttagggtcccaacgggccccaacgggaccccaaacccccgcgttcggtaccctaacctttcccgtccggtttacccccctaaccccgttccccgttcccg

SEQ ID NO: 436784 - DNA, 782 bp, Homo sapiens
  misc_feature: GZ8MTXP01CDYQ0.51.2.A02.1.454.CMB.2.raw
  modified_base (221)..(221): a, c, t, g, unknown or other
  modified_base (415)..(415): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctctatgtgctgagtcacgccaccgtcggtgtcggtcggcccaggacagacggcaggatacgtggtaggggaaacaanagttaggaaagtaaaactgtgacacgtggtaccagacaagaacgccgaggccacgggcccctggcgcgtggtcgtctatgatgacgtcggcccgaccggccctagacgggactcccgtaggaacgtattcctcgtggcctaccccacggtcttccgaggaaacggaaaacccgacccgggccccttaaacccgngggaaacgtacctaactacggaacggtacggggtaaacgggggtacccgggaaaacggggcccgggggtaaagtccggggaaccggggtaaccccgttaaactttaaagttttaaccgggtacgggttacggtaaggggttacgggttaacgggtaaacggttaaacggtttaagggtacgttaacgtaagttacgtacggttcggttaccggttaccggggaaccggtaacgggtaaaccgtaacgggtaaccccgtaaccggttcgaacggttacccgaaaccggaaccccgaaaccgacccccgaaacccgtgtcccgtaacccttaccgttcccgttaccccgttcccccgccccgttaaccg

SEQ ID NO: 436785 - DNA, 582 bp, Homo sapiens
  misc_feature: GZ8MTXP01BFYMF.51.2.A02.1.454.CMB.2.raw
  modified_base (554)..(554): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtcggccccaggacagacggccaggattacctggtagggggaaacaacattaggaaagtaaaactgtgcactggtaccagcagaagccaggccaggcccctgtgctggtcgtctatgatgatcgccgaccggccctgacgggactccccgtagaacgtatttctcgtcggcctccccgagtctctaggaacgaaaaccgacccgggcccaacccgtggacgctatcgagtcgacggggtacgaaagggccggggatcgggacggaccgtacttattacgtgtacgagggtgtagggtatacgttagtagtgatcgatcgtcgtcggaccgtggaccaaggtcaccgttcgtaggcaacgtcccaacgcccaacccgntcgaactctcgttccgtccccgcctccg

SEQ ID NO: 436786 - DNA, 611 bp, Homo sapiens
  misc_feature: GZ8MTXP01AJZKW.51.2.A02.1.454.CMB.2.raw
  modified_base (456)..(456): a, c, t, g, unknown or other
  modified_base (601)..(601): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattaccgtggtaggggaaacaacattaggaaagtaaaactgtgcactggtacagcagaacgccaggccacggcccctgtgcgtggtcgtctatgatgatcggcccgacccgccctcgagggtctcccgtagaacgtacttctcgtcggcctccccgagtctcgtagaacgaaaccgaccggcccacccgtgacgcagtcgacgacgacggggtacgaaacgggccgggatggaacggaccgtaattacgttacgnggtacgagggtgtagggtaattacggtagtgtacgattcagttcgtccgttacggcgtacgggaaccgtacggtccaccgttcgtacggccgaacgaccccgacgccccaacccgtaactcgcctaccgtcgttacccttccccnccccttcccg

SEQ ID NO: 436787 - DNA, 699 bp, Homo sapiens
  misc_feature: GZ8MTXP01APG4I.51.2.A02.1.454.CMB.2.raw
  modified_base (333)..(333): a, c, t, g, unknown or other
  modified_base (337)..(337): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtgcccaggacagacggccaggattaccgtggtagggggaaacaacagttaggaaagtaaaactgtgcactggtaccagcagaagccaggccacggcccctgtgcgtggtcgtctatgatgatcgccgaccgcctcgagggctcccgtagaacgtnttcncgtcggcctcccagctcgtagaacgaaaccacccgggcccacccgtaggacgaccacgtcgaacggcggacggggtaccggaaacggggcccgggggaatacgggaaccgggacccgtaacgtttacgttaacggtcggttacggtaagggttcggtacggggtaattaacggttaagggttacgtaggtaacttcgtaagttcggttacccgttacgggtaacccgttacggggaaaccctaacgggtccctaacccggttcggtaacggcgaaacccggaccccgaaccgggttaccccaaacccccgtgtcccgtaaccacccttccgttacccgttaacccccgaacccgtttccccg

SEQ ID NO: 436788 - DNA, 671 bp, Homo sapiens
  misc_feature: GZ8MTXP01AI6SV.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtaggggaaacaacattaggaagtaaaactgtgcactggtaccagcagagccaggccaggcccctgtgctggtcgtctagtgatgatcgccgaccggcctacgacgggactcccgtagaacgtattcgtcgtcggcctccccgagtctcgtagagaaaccgaccgggcccaccctgacgcatcgagacgacgggtacgaacgggccggggatacggacgggaccgtacttaagttacgtcggtacgtagggtgttagggaattaacgtaggttagtaggtactacgtacgttcgttaccgttcgggaaccgtacggggtaaacccgtaacgggtcccgaacccggttaccggtacgggttacccgaaccggtaaccccgaaaccgggaccccaaacccccgtaacgttccggtaacctaacccgttccggttccccgttaaccccgttaaccccgtttccccg

SEQ ID NO: 436789 - DNA, 697 bp, Homo sapiens
  misc_feature: GZ8MTXP01BYQSV.51.2.A02.1.454.CMB.2.raw
  modified_base (425)..(425): a, c, t, g, unknown or other
  modified_base (690)..(690): a, c, t, g, unknown or other
tcagcgatcgtatacacgaccggtgctcgatttagactcatctacaggggctggggcctaaggaagcagcactggtggtgcctcagccatggcctggaccgttctcctcctcggcctcctctctcactgcacaggctctgtgacctcctatgtgctgagtcacgccaccgtcggtgtcggtcggccccaggacaggacggccaggacttaccgtggtaggggaaacaacgagttaggaaagtaaaactgtgcacgtggtaccagcagacgcgaggccacggcccctgtcgcgtggtcgtctagtgatgatccggcccggacccggccctaggacgggtacctcccgtaggaacgtctttccgtcgtcggccttaccccgagtccgttacgacggaaccgaaaacccgcccgggaaccctacccgnggaaccgacctaacggtcgaacgggtaccgggtaacggggtacggaaacgggggtcccggggatacggggaacggtacccgtaattacgttacgtgacggtagggtaggtaggtaacgttaacggttaggttagcgtaactcgtagttcgttaccggtaccggtaccggttacggaaccgtacggtaaccgtacccgttacgtacggttaccgaccggacccgaaccggcccaaccgtgtcctaactccgtcttcccgttccccncgttccg

SEQ ID NO: 436790 - DNA, 647 bp, Homo sapiens
  misc_feature: GZ8MTXP01C9DXM.51.2.A02.1.454.CMB.2.raw
  modified_base (639)..(639): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccacccgtcggtggtcggtcggccccaggacaggacggccaggacttaccgtggtagggggaaacaactagttaggaaaagtaaaactgtagcacgtggtaaccagacagaacgccgaggccacggcccctggtcgcgtggtctctagtgatgagtcgaccggacccgcctcgacgggactcccgtaggaaccgttattccgtcgtcggtccttccccgacgtcttacgtacgaaccgaaacccgacccgggcccacccgtagaccgctaacgcgaggacgacggggtacggaacgggtaccgggagtacggacggtaccgtattacgttacgtgtacgtagggttcggtaggtaacgttaacgtaggtagtgtatcgtagttcggtacgttccggacgtcggaccgtaggtcccaacgttcgtagccgacgacccgttacgcccaccgtctcgcctactccgttcccgttaacccncccgttcg

SEQ ID NO: 436791 - DNA, 661 bp, Homo sapiens
  misc_feature: GZ8MTXP01AYGP2.51.2.A02.1.454.CMB.2.raw
  modified_base (311)..(311): a, c, t, g, unknown or other
  modified_base (358)..(358): a, c, t, g, unknown or other
  modified_base (399)..(399): a, c, t, g, unknown or other
  modified_base (421)..(421): a, c, t, g, unknown or other
  modified_base (625)..(625): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctggtgtcggtggccccaggacagacgccaggattaccgtggtagggggaaaacaacgagttaggaaagtaaaaactggtgactacgtcgggtaaccaggcaagaacgccgaggcccacggcccctggtcgctggtcgtctagngatgatcgacccggaccggccctgagggactcccgagaacgtattcncgtaggcctaccccgaggtcctgtacgaacggtaaaaaccncccgggcccaacccgtggaacnctactcgaacggacggaacggggtacggaaacgggccgggggatacgggacggaaccgttaacgttacgttaccgttggtacgtagggttcgtagggtaatacgtaaggtagtcgatcgtagtgtcgtccgggtacgtacgggacctaacgggtctacccgttgtacggttccgaaccgacccgaaaccggcccaaacccggtntccgtcaccttccgttacccgttcccttcccttccc

SEQ ID NO: 436792 - DNA, 845 bp, Homo sapiens
  misc_feature: GZ8MTXP01BTHSU.51.2.A02.1.454.CMB.2.raw
  modified_base (352)..(352): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcacgccaccctcggtgtcggtcggccccaggacagacggccaggacttaccgtggtaggggaaacaacagttaggaaagtaaactgtgcacgtggtaccagcagaacgccgaggccacggcccctggtcgcgtggtcgtctatgatgacgtcgcccgaccggccctagacgggtactcccgtagaaaccgttntttcctcgtcggccttccccgacggtcgttacgtacggaaaccgaaaacccgacccgggcccctaaacccggtggaacggacctaacgtccggaaacgggtaccgggtaacggggggttaaccgggaaaccgggggtacccggggggtaaacgttacgggggaaacccggggtaaccccgttaaaccgttttaacgtttaacccggttgggttaccggggttaacggggtttacggggttaagggggttaacccttaacgggttttaaagggttaagggttaccggttaattaccggttaacgttccggtttaacccggtttcccggggtaaacccggttaccgggggtaaacccgtaacggggttccccgtaaacccgggttcccggtaaacggttcccgaaacccgtaccccggaaaccgggttcccccaaaccccggtcttcggtaaccctaccttccggttacccgttcccccgttaaccccgttcccg

SEQ ID NO: 436793 - DNA, 511 bp, Homo sapiens
  misc_feature: GZ8MTXP02JUXBO.51.2.A02.1.454.CMB.2.raw
  modified_base (410)..(410): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaactgtgcactggtaccagcagaagccaggccaggcccctgtgctggtcgtctatgatgatgccgaccggccctcgaggggactcccgtgaacgattctctggctccccagctctgagaacacgggccaccctgagcatcagcagggtcgaaaggccggggatggagccgactatacngtcaggtgtgggatacgtagagtgatcatgtctcggacctgggacaaggtcacgtctaggcacgccaggcccaacccaatgtccactctcgtcccacctcc

SEQ ID NO: 436794 - DNA, 557 bp, Homo sapiens
  misc_feature: GZ8MTXP02IDCPR.51.2.A02.1.454.CMB.2.raw
  modified_base (359)..(359): a, c, t, g, unknown or other
  modified_base (367)..(367): a, c, t, g, unknown or other
  modified_base (529)..(529): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaaagtaaaactgtgcactggtaccagcagaagccaggccaggcccctgtgctggtcgtctatgatgatcgcccgacccggcccctcgaggggactccccgtaggaaacgattcctctggcctcccagcctcngagaaccnccggccaccctgacgcatcagcgacggggtcgaaaggccgggggatcggaggcccgaattattacgtggtcagggtggtgggaatacgtagtagtgatcattgtcgttcggacctgggaccaaggtccaccgtcaggtcacgacccaaacggcccaaacccnctacgtccactccttctccccaccctcc

SEQ ID NO: 436795 - DNA, 531 bp, Homo sapiens
  misc_feature: GZ8MTXP02IT5OT.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaaagtaaaactgtgcactggtaccagcagaagcaggccaggcccctgtgctggtcgtctatgatgatgccgaccggccctgagggactcccctgaaccgtattctctggcctcccagctctgacgaaccacggccaccctgacgcatcagcaggggtcgaaaggccggggatggacgcgactattactgtcgaggtgtgggatacgtagtagtgatcatgtcttcggaccgtggaccaaggtcaccgtctaggtcacgccgaacgcccaacccaacgtcgtaccactctcgttccccaccttcc

SEQ ID NO: 436796 - DNA, 511 bp, Homo sapiens
  misc_feature: GZ8MTXP02JWNHS.51.2.A02.1.454.CMB.2.raw
  modified_base (307)..(307): a, c, t, g, unknown or other
  modified_base (351)..(351): a, c, t, g, unknown or other
  modified_base (411)..(411): a, c, t, g, unknown or other
  modified_base (488)..(488): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgacggccctnagggatccctgaacgattctctggctccccagcctctgagaacncgggcccaccctgacgcatcagcaggggtcaaaggccgggggatggaggcgactattacngtcaggtggtgggatacgtagtagtgatcagtgtctcggacctggaccaggtcacgtcaggtcagcccagccacccncgtcgcactctcgtcccgcctcc

SEQ ID NO: 436797 - DNA, 585 bp, Homo sapiens
  misc_feature: GZ8MTXP02HDGK1.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtgggggaaacaacattggaagtaaactgtgcactggtaccagcagaagccaggccaggcccctgtgctggtcgtctatgatgatgccgaccggccctgagggactcccgtgaacgattctctggctccccagctctgacgaacacggcccacctgacgcatcagccgaggggtcgaaacggcccgggggatcgggacgggccgtaacttagttaaccgtggtacgagggttggtaggggtatacgttaggtagtgaatcgagttgtcgttcggaccgtggggaacctaacggtcaccggtcctacgggtaccacggaccccgaaacggccccaaacccgtctcgtaccacttcctccgttacccccacccttccc

SEQ ID NO: 436798 - DNA, 518 bp, Homo sapiens
  misc_feature: GZ8MTXP02JP3H8.51.2.A02.1.454.CMB.2.raw
  modified_base (308)..(308): a, c, t, g, unknown or other
  modified_base (494)..(494): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctnagggactccctgaacgtattctctggctccccagctctgagaaccacggccaccctgagcatcagcagggcaaggccggggatggaggccatatactgtcaggtgtgggatacgtagtagtgaatcgatgtcgttcggacctggggaccaaggtcaccgtctagcacgcccaacggcccaacccgncgtacactctcgtcccgcccttcc

SEQ ID NO: 436799 - DNA, 513 bp, Homo sapiens
  misc_feature: GZ8MTXP02JZ8PF.51.2.A02.1.454.CMB.2.raw
  modified_base (306)..(306): a, c, t, g, unknown or other
  modified_base (413)..(413): a, c, t, g, unknown or other
  modified_base (485)..(485): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggcccaggacagacggccaggattacctgtgggggaaacaacattggaagtaaaactgtgcactggtaccagcagaagccaggccaggcccctgtgctggtcgtctatgatgatgccgaccgccctnagggatccctgaacgattctctggctcccagctctgagaacacggccacctgacgcatcagcagggtcgaaggccggggatggaggccgactattactgtcaggtgngggatacgtagtagtgatcatgtcttcggactggaccaaggtcacgtcaggtcacgccaacggcccaacccncgtcgtcactctcgttcccgcccttccg

SEQ ID NO: 436800 - DNA, 602 bp, Homo sapiens
  misc_feature: GZ8MTXP02HLC6E.51.2.A02.1.454.CMB.2.raw
  modified_base (330)..(330): a, c, t, g, unknown or other
  modified_base (356)..(356): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattaggaaagtaaactgtgcactggtaccagcagaagccaggccaggcccctgtgctggtcgtctatgatgatcgccgaccggccctcgagggactccccgtgaacgnttctctggctcccagctctgagaacncggccaccctgacgcatcagcaggggtcgaaggccggggatggacggccgtactagttacgtgtcgagggttgtagggattaacgttaggtagtaggatcgagttcgttcgttaccgggaccgttgggggaaccctaaaggggttccacccgggttccgtaaacgggtccgaacggaccccgaacggaccccaaacccccgtaacgtcgtacctacctccttccgttaccccctacccctttcccg

SEQ ID NO: 436801 - DNA, 530 bp, Homo sapiens
  misc_feature: GZ8MTXP02FP5OM.51.2.A02.1.454.CMB.2.raw
  modified_base (330)..(330): a, c, t, g, unknown or other
  modified_base (407)..(407): a, c, t, g, unknown or other
  modified_base (501)..(501): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattaggaaagtaaaactgtgcactggtaccagcagaagccaggccaggcccctgtgctggtcgtctatgatgatgccgaccggccctcagggatccctgaacgattcntggctcccagctctgagaacacggccacctgagcatcagcaggggtcgaaagccggggatgacggccgactattacngtcagggtgtgggatagtagtagtgatcgatgtcgttcggacctagggaccaaggtccaccggtcctaggtcacgcccaaacggcccaaacccncgtacgtcacctctcgtccccacccttcc

SEQ ID NO: 436802 - DNA, 587 bp, Homo sapiens
  misc_feature: GZ8MTXP02H890G.51.2.A02.1.454.CMB.2.raw
  modified_base (375)..(375): a, c, t, g, unknown or other
  modified_base (435)..(435): a, c, t, g, unknown or other
  modified_base (548)..(548): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccacctcggtgtcggtggccccaggacagacggccaggattaccgtggtagggggaaaacaacattaggaaagtaaaactgtgcacgtggtaccagcaagaagccaggccacggcccctgtcgctggtcgtctatgatgatcgcccgaccgccctgacgggactccctagaacgtattcctcgtggcctccccagtccttcgagacgaaaccncggcccaccgtgacgcatcagcgagggtacgaaaggccgggatggacggccgatatacgngtcgaggtggtgggatacgtagagtagatcgagtcgtcgttacggaccgtacgggaaccaacggtcctacccgtcgtacggaccaaccgaccccgaaacggacccccaacccncgttcgacctacctccgttcccgttaccccaccccttcc

SEQ ID NO: 436803 - DNA, 527 bp, Homo sapiens
  misc_feature: GZ8MTXP02GC4M2.51.2.A02.1.454.CMB.2.raw
  modified_base (353)..(353): a, c, t, g, unknown or other
  modified_base (357)..(357): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtagggggaaacaacattaggaaagtaaaactgtgcactggtaccagcagaagccaggccaggcccctgtgctggtcgtctatgatgatgccgaccggccctgaggggactccctagaacgattctctggctcccagctctganaacncggccacctgagcatcagcagggtcaaggccggggatggagccgacttattactgtacgaggtgtggggatacgtagtagtgatcgtatgtcttcggactgggacaggtcacgtctagcacgcccaacggcccaacccaagtcgtacactcgtccgttccccgcccttcc

SEQ ID NO: 436804 - DNA, 586 bp, Homo sapiens
  misc_feature: GZ8MTXP02IP2JS.51.2.A02.1.454.CMB.2.raw
  modified_base (351)..(351): a, c, t, g, unknown or other
  modified_base (382)..(382): a, c, t, g, unknown or other
  modified_base (396)..(396): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtagggggaaacaacattaggaaagtaaaactgtgcactggtaccagcagaagcaggccaggcccctgtgctggtcgtctatgatgatgcccgaccggccctgagggatcccctgaacgattctctggctccccagctctganaacgacgccacctgagcaatcaagcagggtnaaaggccgggtagngacgcgatatatgtgaggtgtaggtataacgttagtagtagatctagttcgtcgttacggacgtacgggaaaccgtaacggtccgtaccgttaccgtacggtaccgaaccgacccgaaaaccggtaccccaaaaccccgtaacgtacgtacctaccttacccgttacccgtttaccccctacccgttccg

SEQ ID NO: 436805 - DNA, 663 bp, Homo sapiens
  misc_feature: GZ8MTXP02IXK43.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtcggccccaggacagacggccaggattacctggtagggggaaacaacattaggaaagtaaaactgtgcactggtaccagcagaacgccaggccaggcccctgtgcgtggtcgtctatgatgatcgccgaccggccctcgagggactccccgtagaaccgtacttctcgtcggtcctccccagtcctctacgaacgaaccgaccgggcccacccgtgacgcatcgagcgaggggtacgaaacggcccgggggatggaacggaccgacttagttacgtgtacgagggtaggtagggaacttacgtagtacgtaggtatccgtagttcgttacggtttccgggaaccgttacgggggaacctaacggggtaccctacccggttccgtaacggggtccaaccggtacccccggaaaaccggacccccaaaaccccgtaacgttccggtacctacccgttccttacccgttccccctacccctttccccg

SEQ ID NO: 436806 - DNA, 549 bp, Homo sapiens
  misc_feature: GZ8MTXP02H5DDH.51.2.A02.1.454.CMB.2.raw
  modified_base (353)..(353): a, c, t, g, unknown or other
  modified_base (520)..(520): a, c, t, g, unknown or other
  modified_base (542)..(542): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtgggggaaacaacattggaaagtaaaactgtgcactggtaccagcagaagccaggccaggcccctgtgctggtcgtctatgatgatgccgaccggcctcagggactccctgaacgattctcgtggctcccagctctgagaacncggccaccctgacgcatcagcaggggtcgaaggccggggatggacggccgacttattacgtgtcgagggttggtagggtattacgtaggtacgtgaatcagtgttcgtcggaccgtgggaaccaaggtcaccggtcctaggtccacgcccgaacggcccaaacccgngtcgtacactctccggttcccncccttcc

SEQ ID NO: 436807 - DNA, 556 bp, Homo sapiens
  misc_feature: GZ8MTXP02HSX6W.51.2.A02.1.454.CMB.2.raw
  modified_base (280)..(280): a, c, t, g, unknown or other
  modified_base (377)..(377): a, c, t, g, unknown or other
  modified_base (404)..(404): a, c, t, g, unknown or other
  modified_base (425)..(425): a, c, t, g, unknown or other
  modified_base (551)..(551): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtagggggaaacaacattaggaaagtaaaactgtgcactggtaccagcagaagccaggccacggcccctgngctggtcgtctatgatgatggccgacccggcctcgagggactcccgtagaacgattctctggctcccagctcgtagagaaccacggccacctggacncaatcagcagggtcgaaaggccggganggacgcgactattacgacgtnagggtgagggtaatacgtagtaaggtgatgatcgtcgttacggacctgggaaaccgaaggtccacggtccgtaggccaacgccccaaaggccccaaaccccgaatcgactacctctccgtcccccncctcg

SEQ ID NO: 436808 - DNA, 689 bp, Homo sapiens
  misc_feature: GZ8MTXP02I0ZVX.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtcgacctcctatgtgctgagtcacgccacccgtgggtgtcggtcggccccgaggacaggaccggccgaggtacttaccgtgggtagggggaaacaactagttaggaaagtaaactgtgcacgtggaccagcagaacgccaggccacggcccctgcgcgtggtcgtctatgatgatcgcccggacccggccctggagggtactcccgtagaacgtacttcctcgtcggcctacccgagtcctcgtaggaacgaaacccgcccgggcccacccgtgacgacacgtacgaggcgacgggggtacggaacgggcccgggggaatacgggaacggacccgtaactttagttacgtcggtacgtagggttgggtagggtaacttacgtaggttagtgtactcgtagttcggttcgtacggtaccgtacgggaacctaacggtaccgtacccggttacgtacgggtaccaaccggacccgaaaccggcccccaaaaccccgtcgttaccgtaccctaccttcccggtttacccgtttacccccaaccccttttcccg

SEQ ID NO: 436809 - DNA, 566 bp, Homo sapiens
  misc_feature: GZ8MTXP02JR2RS.51.2.A02.1.454.CMB.2.raw
  modified_base (329)..(329): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgacccgaccggccctcgagggactcccgtgaacgnttcctctggctccccagctcgtagacgaaccacgggcccaccctgacgccatccgagcgaggggtaccgaaaggcccgggggaatcgggacgggaccgtacttattaacgtgtacgagggtgtagggatacgtagtagtgatcgatgtcttcggaccgtggaactaaggtccaccgtacctaggtccacgacccaacggcccaacccgaatcgacactctcgttcccccacttcccg

SEQ ID NO: 436810 - DNA, 643 bp, Homo sapiens
  misc_feature: GZ8MTXP02F1YDF.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtagggggaaacaacattaggaaagtaaaactgtgcactggtaccagcagaagcaggccacggcccctgtgctggtcgtctatgatgatcgccgaccggccctcgacgggactcccgtagaacgtattcctcgtcggccttccccacgtcctcgtacgaacggaaaccaccgggccccaaccccgtggaacgaccactacgagccgtaaagggggtcgaaacgggcccgggggaatcgggaacggtaccgacttaagttaccgtgtacgagggttggtacggggaattacgtaggttagtagtaatcgagttcggttcgtttacggaccgttaggggacctaaggtccctaccggtacgtacggtccaacgccccgaaacggcccaaaaccccgtgtaccgtacctaccttccttaccgtccccctaccctccg

SEQ ID NO: 436811 - DNA, 708 bp, Homo sapiens
  misc_feature: GZ8MTXP02JPYLS.51.2.A02.1.454.CMB.2.raw
  modified_base (368)..(368): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtggggaaacaacattggaagtaaactgtgcactggtaccagcagaagccaggccaggcccctgtgctggtcgtctatgatgatgcccgaccggcccctgacggggctccccgtagaacgatttcctcgtggcctccccgagccttcgtagacgaaaccnccgggcccaaccctgacgcagtcagcgaggggtcgaaaggccggggatcggacggaccgtactaagtttacgtgtcgaaggggttggtaggggaattaacgtaggttagtggtaacttacgtaagttcggtttccgtttaccggggtaaccccggttagggggaaaccccgtaaaacggggtttccccgaaaaccccgggtttaccgttaaaccgggggttacccaaaccggggacccccgaaaaaccggggacccccctaaaaccccctaaccgttccggttaaccctaaccccggtttccctttcccggtttaacccccccgaacccccttttccccg

SEQ ID NO: 436812 - DNA, 547 bp, Homo sapiens
  misc_feature: GZ8MTXP02FTYLE.51.2.A02.1.454.CMB.2.raw
  modified_base (514)..(514): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaaagtaaactgtgcactggtaccagcagaagccaggccaggcccctgtgctggtcgtctatgatgatgccgaccggccctcgagggactcccctgaacgtattctcgtggctccccagcctctgacgaacacggccacctgagcatcgagcgagggtcgaaaggccggggatggacggccgacttagttacgtgtacgagggtggtgggaatacgtagtagtgatcatgtcttcggactgggaccaggtccaccgtctacggcacgacccgaacggcccaaaccccncgtcgactacctcgtccgtccccgcctttcccg

SEQ ID NO: 436813 - DNA, 820 bp, Homo sapiens
  misc_feature: GZ8MTXP02IX88E.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacaggacggccaggattaccgtggtagggggaaacaacattaggaaagtaaaactgtgcactggtaccagcagaagccaggccaggcccctgtgcgtggtcgtctatgatgatcgcccgaccggcccctgacgggactcccgtagaacgtattccgtcgtggcctccccgagtccttcgtacgaaacggtaaacccgacccgggccccctaacccccgttaggaccggacctaacgtaccgaaaggggtacccggtaaacgggggggttacccgggaaaaccgggggcccccggggggtaaagttacgggggaaaccgggggtacccccggttaacgtttaaacgttttaaccggtcgggtaccggtaagggggtttgggttaaacgggggttaaagtttaaccggtttaaggggtttaaagggttggttaaacgttaccgttaaggtttcggtttaccggtttacccggggaacccggtttacgggggaaacccgtaaacggggttacccgtaacccggttcccggttagggtacccgaaccggtacccccgaaaacgggtcccccaaaacccgtccgttaccggtaccttaaccgttcccgtttacccgttaccccctaccctttccccg

SEQ ID NO: 436814 - DNA, 603 bp, Homo sapiens
  misc_feature: GZ8MTXP02GD5BV.51.2.A02.1.454.CMB.2.raw
  modified_base (450)..(450): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctggtgtcggtcggccccatgacagacggccaggattaccgtggtaggggaaacaacagttaggaaagtaaaactgtagacacgtggtaccagacaagaacgccgaaggccacggcccctggtcgcgtggtcgtctagtgatgactcgccgaccggcctcgacggactccgagtaacgtacttctcgtcggccctacgacgtctcgtagaacgaacgccggcccaccgtgacgcatcgagcgagggtacgacgggcgggatcggacgccctaatacgttacgnggtacgtagggtgtagggtacttagtagtacgtagacttacagttacgttcggtaccggacgtagggaacctacggtccgaccgttccgagtaccacggaacccacggacccctaaccgtctcgtacctccgttctacccgtccccgtacccc

SEQ ID NO: 436815 - DNA, 754 bp, Homo sapiens
  misc_feature: GZ8MTXP02GWR94.51.2.A02.1.454.CMB.2.raw
  modified_base (338)..(338): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtcggccccaggacagacggccaggattaccgtggtagggggaaacaacagttaggaaagtaaaactgtgcactggtaccagcagaagccaggccacggcccctgtgctggtcgtctatgatgatcggccgaccggccctgagggactccccgagaacgtnttcctcgtggctcccgagctcgtagaacgaaccgaccgggccctaacccgtggacgacacgtaccgaggacgtaacgggggtaccggaaacgggacccggggggtaacgttacggggaacccggggtacccggtaaaccgttttaacgtttaaccgttcggggttaaccgtaggggggttacggttagggggtaaactttaaccggttaagggttagtagggtactacggttaactttcgggttcccgttaaccggggtacccgttagggggaaacccgtaaaccggggtaccctacccgggttaccgtaaacggggtcccaaaccggaccccgaaaccggggtacccccaaaccccggtaaccttccggttaccaccctttccggtcccgtttaccccccaacccccgtttcccg

SEQ ID NO: 436816 - DNA, 639 bp, Homo sapiens
  misc_feature: GZ8MTXP02JRK18.51.2.A02.1.454.CMB.2.raw
  modified_base (378)..(378): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtaggggaaacaacattaggaaagtaaaactgtgcactggtaccagcagagccaggccaggcccctgcgctggtcgtctatgatggatcggcccggaccggccctgacgggactccccgtagaacgtattcctcgtcggcctccccgagtcctactaggaacgaaaccnccgggccctaacccgtggactaccatcgacgtacgaggggtaccgaaacgggccggggaatggaacggtccggaaacttacgttaccgtgtacgtagggttgtacggggtaatacgttagtagtaggaatcgaagttcggttcgtacggtaaccgtcgggaaccgtacgggttaccgaccgttacgttacgggaccaccggacccaaaccggtccccaaaccctcgtactaccgtacttccgtaccgtacccctaccgtcc

SEQ ID NO: 436817 - DNA, 589 bp, Homo sapiens
  misc_feature: GZ8MTXP02HE4CQ.51.2.A02.1.454.CMB.2.raw
  modified_base (281)..(281): a, c, t, g, unknown or other
  modified_base (332)..(332): a, c, t, g, unknown or other
  modified_base (451)..(451): a, c, t, g, unknown or other
  modified_base (564)..(564): a, c, t, g, unknown or other
  modified_base (583)..(583): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggcaggattacctggtagggggaaacaacagttaggaaagtaaaactgtgcactggtaccagcaagacgccaggccacggcccctgngctggtcgtctatgatgatcgcccgaccggcctgaggactccctagaactnttctcgtcggcctccccgagtcctcgtaggacgaaacccgccgggtccccaccgtagacgcctatacgagcgagggggtacgaaacgggccggggatcggacggaccctagtattacgnggcagggtggtaggataacgttagagtagtatcgtagttcggtccgttacgggaccgtagggaccgtaaggtcctaccggtcctacgggcaccggaccgaacgcccaaaccgntcacgctctcccgtacccnccctcg

SEQ ID NO: 436818 - DNA, 634 bp, Homo sapiens
  misc_feature: GZ8MTXP02F8FMR.51.2.A02.1.454.CMB.2.raw
  modified_base (366)..(366): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacagccaggattaccgtggtagggggaaacaacagttaggaaagtaaaactgtgcactggtaccagcagaagccaggccaggcccctgcgcgtggtctctatgatgatcgccgaccggccctcgacggactcccgtagaactattctctggccctccagctcgtagaacgaacnccggcccaccgtgacgcatcgagcgagggtcgaaggccgggatggacggccgtatacgttacgtgtacgtagggtgtagggaacttacgtaggttagtgacgtacgtagttcggttccgttacgggaaccgtacggggaacccgtaaacgggttccccgtacccggttaccgtaacgggtacccgaacccggaccccgtaaacggaccccccaaaccccgtacgttaccgtacctaccttcccgttacccgtttaccccctacccccg

SEQ ID NO: 436819 - DNA, 732 bp, Homo sapiens
  misc_feature: GZ8MTXP02GCY95.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtggtcggtggccccaggacagacggccaggattacctggtagggggaaacaacattaggaaagtaaactgtgcactggtaccagcagaagccaggccaggcccctgtgctggtctctatgatgatcggcccgaccggcccctcgacggggacttccccgtaggaaaccgtactttccgtcgttcgggccttacccccgagtcccttacgtaggaacggaaaacccacccgggccccaacccccgtggaacgaccaacttaccgaacggccgaaagggggtaccggaaaacggggccccggggggaaattcggggaacgggaccccgtaacgttaacgtttaacccgtgggtaccgaggggtttggtaggggaattaacgtaggttagtaggtataccgtaagttcggttacgtttaccgggaccgttacggggaaccctaaaacggggtccctaaacccggttccgttaacgggacccgaacgaccccgaaacggcccccaaaacccccgtgtaccggtaccctaccttccgttacccgttaccccctaccctttccccg

SEQ ID NO: 436820 - DNA, 528 bp, Homo sapiens
  misc_feature: GZ8MTXP02JSG9F.51.2.A02.1.454.CMB.2.raw
  modified_base (275)..(275): a, c, t, g, unknown or other
  modified_base (306)..(306): a, c, t, g, unknown or other
  modified_base (311)..(311): a, c, t, g, unknown or other
  modified_base (348)..(348): a, c, t, g, unknown or other
  modified_base (363)..(363): a, c, t, g, unknown or other
  modified_base (404)..(404): a, c, t, g, unknown or other
  modified_base (523)..(523): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgngctggtcgtctatgatgatgccgaccgcctnagggntccctgaacgattctctggctcccagctctgagaacncggccaccctgacgnatcagcagggtcgaaaggccggggatggaggccactatacngtacaggtgtgggatacgtagtagtgatcgatgtcgttcgaccgtgggaccaaggtccaacgtcaacggtcacgcccaaacggccccaaacccaacgtcgacctactctcgttcccccncctcg

SEQ ID NO: 436821 - DNA, 575 bp, Homo sapiens
  misc_feature: GZ8MTXP02I2XG4.51.2.A02.1.454.CMB.2.raw
  modified_base (307)..(307): a, c, t, g, unknown or other
  modified_base (312)..(312): a, c, t, g, unknown or other
  modified_base (323)..(323): a, c, t, g, unknown or other
  modified_base (390)..(390): a, c, t, g, unknown or other
  modified_base (403)..(403): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacaggacggccaggattacctgtgggggaaacaacattggaagtaaactgtgcactggtaccagcagaagccaggccaggcccctgtgctggtcgtctatgatgatgccgacggccctnagggntccctgaacgnttctctggcctcccagctctgagaaccacgggccaccctgagccatcagcaggtcaaagccggggangcgacatatacgngtgaggtgtaggatagtagtagtagatacgagtcgtcgtacggaccgtacgggaccgtaacggtaccgtaccggttaccgtacgggtaccaaccggtacccgaaacggtccccaaaacccgtcgtaccgtacctacccgttaccgttcccggttacccccgtccccgttccg

SEQ ID NO: 436822 - DNA, 626 bp, Homo sapiens
  misc_feature: GZ8MTXP02GZ9SN.51.2.A02.1.454.CMB.2.raw
  modified_base (416)..(416): a, c, t, g, unknown or other
  modified_base (589)..(589): a, c, t, g, unknown or other
  modified_base (611)..(611): a, c, t, g, unknown or other
  modified_base (621)..(621): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtggtcggtcggccccaggacagacggccaggacttacctggtagggggaaaacaactattagggaaagtaaaactgtgacacgtaggtaccagcaagaagcccgaggccacggcccctgtggcctggtccgtctatgacgtgagtccgcccggaaccccggcccctacggaggggtacctcccccgtaggaaacgtactttccgtcgtcggtcctcccccgagtccttcgaggaacgaaacccnccgtccccgacccgtaggacacctatcgaaacgcggaggggtaacgaacggggcggggtatacgggacggtacctaacgttcttaacgtgtacgtagggtacgggtggtaaacttacggtaagtcgtagagtctagttcgtcgttacggccgtagccgaagtccgacgtcgcncacgccacgcccactgcactcncgtcctaccnctccg

SEQ ID NO: 436823 - DNA, 521 bp, Homo sapiens
  misc_feature: GZ8MTXP02FHBPI.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccccagctctgagaacacgggccaccctgagcatcagcagggtcgaaagccggggatgaggccatattactgtcaggtgtgggatacgtagtagtgatcatgtcttcggacctgggaccaaggtcaccgtcacggtcacgcccgaagcccaaacccgaactcgacactctcgttcccccaccttccc

SEQ ID NO: 436824 - DNA, 757 bp, Homo sapiens
  misc_feature: GZ8MTXP02G4KR3.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcgacctcctctctcactgcacaggctctgtgacctcctatgtgctgagtcagccaccctcggtgtcggtggccccaggacagacggccaggacttaccgtggtagggggaaaacaacagttaggaaagtaaaactgtgcactggtaccagcagaagccaggccaggcccctgtgctggtcgtctatgatgatcgcccgaccggccctagacgggactccccgtagaacgtacttcctcgtcggtcctaccccgacgtccttaccgtacggaacggaaacccgacccgggacccctaaccccgtaggaccgaccacgtaccgaacgggaccggtaacgggggtaccgaaacgggggtcccgggggagtacggggaacgggtacccgtaacgttaagtttacccgtagggtaccgtaagggttaggggtcgggtaaattacgttagggttacgtagggtaactccgtaagtttccgggttcgttaccggggtaccggtacggggtaaaccgtaaccgggtcccgtaaacccggttccgtaacggtacccgaccggtaacccccgaaacgggtaccccctaaaaccccgtcgttaccggtacccgtaaccctttccgttaccccggtttacccccctaaccctttccccg

SEQ ID NO: 436825 - DNA, 574 bp, Homo sapiens
  misc_feature: GZ8MTXP02FMH66.51.2.A02.1.454.CMB.2.raw
  modified_base (276)..(276): a, c, t, g, unknown or other
  modified_base (339)..(339): a, c, t, g, unknown or other
  modified_base (356)..(356): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaaagtaaaactgtgcactggtaccagcagaagccaggccaggcccctgngctggtcgtctatgatgatcgcccgaccggcccctcgaggggactcccctagaacgtattccnctcggctccccagcctntaggacgaaaccaccgggcccaccctgagccaatccagcgaggggtcgaaaggccggggaatggacggccgacttattacgtgtcgagggtggtgggatacgtagtagtgtatcagtgtcgttcggactggggaactaaggtccaccgtcacggtacgacgacccaaacggccccaaaccctaagtcgtacctacttccgtcctaccccacccttccg

SEQ ID NO: 436826 - DNA, 547 bp, Homo sapiens
  misc_feature: GZ8MTXP02JU359.51.2.A02.1.454.CMB.2.raw
  modified_base (491)..(491): a, c, t, g, unknown or other
  modified_base (520)..(520): a, c, t, g, unknown or other
  modified_base (527)..(527): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctggtgggggaaacaacattaggaaagtaaaactgtgcactggtaccagcagaagccaggccaggcccctgtgctggtctctatgatgatcgccgaccggccctgacgggactcccgtagaacgtattctctcggctccccgagctcgtggaacgaaccaccgggcccaccctggacgcatcgagcgaaggggtcgaaggcggggatggacggccgactattacgtgtcagggtgtgggatacgtagtagtgatcagtgtcgtcggacgtggacaggtcaccgtnacgtcacgacccgaacgcccaacccgtcncgtaccncgtcctcgttccccgcctcc

SEQ ID NO: 436827 - DNA, 601 bp, Homo sapiens
  misc_feature: GZ8MTXP02H6I5D.51.2.A02.1.454.CMB.2.raw
  modified_base (337)..(337): a, c, t, g, unknown or other
  modified_base (350)..(350): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctggtgtcggtggccccaggacagacggcaggacttaccgtggtaggggaaacacgagttaggaaagtaaactgtagcactggtaccagcagaacgccaggccacggcccctggtacgctcggtctctagtgatgatcgccgaccggcctgaggactccagacatctcgnggctccgagcctntacgagaacgaccgccaccgtagacgtcatcagacgagggtcgaaggccgggataggacgtacgacttatcgtagtcgaggttggtaggtaatacgttagtagtagtagtactagttcgttcgtacggtaccgtaggggaaacctaacggccgtaccggttaccgacgtaaccgaccgacccgaaacgcccccgaaaccctaagttccggtaacctactaccggtaccctttacccccgaccgtttacccg

SEQ ID NO: 436828 - DNA, 714 bp, Homo sapiens
  misc_feature: GZ8MTXP02I0Y5K.51.2.A02.1.454.CMB.2.raw
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacaggacggccaggacttaccgtggtagggggaaacaacgagttagggaaagtaaaactggtgcacgtggtaaccagcaaggaacgccgaggccgaggcccctgtgcgtggtcgtctagtgatgactcggcccggacccggcccctggacggggacctccccgtaggaaaccgtatttccgtcgtcggtcctcccgaacgtcctacgtacggaagaaacccgacccgggcccaacccgtaggacgtacctaacgtcgacgggtaccggaacgggggtaaccggaacgggggacccgggggtaaagtcggggaaccgggtacccgtaccgtttaaagtttaccgtgggtacggtagggtaggggtacgggttacttaacggttagtaggtgtaacgtctagttcgttcgttaccgggacggtacggacgtaacgggttccacccgttacgtacgggaccaccggacccgaaccggaccccaacccgtcgccgtacctaccttccttacccgttccctacccgttccg

SEQ ID NO: 436829 - DNA, 662 bp, Homo sapiens
  misc_feature: GZ8MTXP02IG2A4.51.2.A02.1.454.CMB.2.raw
  modified_base (324)..(324): a, c, t, g, unknown or other
  modified_base (334)..(334): a, c, t, g, unknown or other
  modified_base (360)..(360): a, c, t, g, unknown or other
  modified_base (414)..(414): a, c, t, g, unknown or other
tcagcgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtcggccccaggacagacggccaggattacctgtgggggaaacaacattaggaaagtaaaactgtgcactggtaccagcagaagccaggccacggcccctgcgctggtctctatgatgatgcccgaccggccctgagggactcccgngaacgattcncgtcggctcccagcctctgagaaccncggccctaacctgacgcactcacgcgaaggggtccgaaaggcccgggggtaaanacgggacgaccgtaacttaacgttacgtaggtacgtagggttacggtagggtaaacttacggttaagttacggtagtacttacgtagttcggttaccggttaccgggtaccgtaacgggtaacccgtaacggttacccgaccggttaccggtacggtaccgaaccggaccccgtaaaccggacccccaaacccgtcgttaccgtacccttaccgttcccgttacccgtttacccccaccccgtttccg

SEQ ID NO: 436830 - DNA, 503 bp, Homo sapiens
  misc_feature: GZ8MTXP01AK1I9.13.6.A06.1.454.CMB.2.raw
  modified_base (257)..(257): a, c, t, g, unknown or other
  modified_base (281)..(281): a, c, t, g, unknown or other
  modified_base (486)..(486): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggattggtanctgcagaggcagggcagtccccanaactcctgatctattgggggttctaatcgggcctccggggtcctaagaggttcagtggcagtgatcaggcacagattttacactagaaaatcagcagagtggaggctagaggtagtggttggggtttattacgtgtcagtgcaagctactacaacctctgcgtacttcggcctgggaacaagttgagatacaagacgttgttggntgcacattctgttcttc

SEQ ID NO: 436831 - DNA, 607 bp, Homo sapiens
  misc_feature: GZ8MTXP01AKU8B.13.6.A06.1.454.CMB.2.raw
  modified_base (261)..(261): a, c, t, g, unknown or other
  modified_base (282)..(282): a, c, t, g, unknown or other
  modified_base (287)..(287): a, c, t, g, unknown or other
  modified_base (291)..(291): a, c, t, g, unknown or other
  modified_base (325)..(325): a, c, t, g, unknown or other
  modified_base (394)..(394): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagacgcctcctgcatagaatggatataactattggattggtatcngcagagcaggcacgtccccanactcngatntagttgggtctagtcggtcctccgggtacctagnggttcaggtggcaggtgatacgaggcacgagttatttacaacttagaaactcagcaggaggtggaggtntagggaggtagtttgggttagggtttactacgtgactaggtgacgtacgtaccttactaacccgtaccgtcgtacggtccggttaccgtttccgggacccggttaagggaaaccgtaaaggttagggaacttaaacgttaaaccgaaaacggttacggttcggttacggtccgttacgaaccgtaacctcttacgtttccgttcgtttaaccc

SEQ ID NO: 436832 - DNA, 542 bp, Homo sapiens
  misc_feature: GZ8MTXP01DFEJT.13.6.A06.1.454.CMB.2.raw
  modified_base (256)..(256): a, c, t, g, unknown or other
  modified_base (282)..(282): a, c, t, g, unknown or other
  modified_base (333)..(333): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaatggatataactattggattggtanctgcagaggccagggcacgtccccanaactcctgatctagttggggttctaagtcgggcctccggggtccctaacgnggttcagtggcagtggatcgaggcacagtacttttacactagaaaatcagcaggagtggaggcgtaggaggtagttggtttaggggttattacgtgcagtgacaagtcctactaccaacctctcgcggtacgtttcggcccgtgggaaccgaaaggttggacgttagtacgaaacgaacgttgcggctgcaccattctcgttcttaacc

SEQ ID NO: 436833 - DNA, 556 bp, Homo sapiens
  misc_feature: GZ8MTXP01C9KG6.13.6.A06.1.454.CMB.2.raw
  modified_base (255)..(255): a, c, t, g, unknown or other
  modified_base (282)..(282): a, c, t, g, unknown or other
  modified_base (391)..(391): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccctggagagccggcctccatctcctgcaggtccagtcagagcctcctgcatagaaatggatatactattggatggtanctgcagagccaggcagtccccacaacncctgatctattggggttctaatcgggcctccggggtcctaacgaggttcacggtggcagtggatcaggcacagtattttacactagaaaatcaagcaggagtggagggngtaggaggtagtgggttagggttattatgacagtagtacgaacgtactactaactacctacgtcgtcggtaccgttccggtccgtacggtaacgaaacggttaggtaagaagtaacgtaaacgttaacgttcgttcggtcgtcgcgactacttactcgttcgttc

SEQ ID NO: 436834 - DNA, 516 bp, Homo sapiens
  misc_feature: GZ8MTXP01CFIY0.13.6.A06.1.454.CMB.2.raw
  modified_base (259)..(259): a, c, t, g, unknown or other
  modified_base (331)..(331): a, c, t, g, unknown or other
  modified_base (496)..(496): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtanctgcagaggccagggcagtccccacaactcctgatctattggggtctaagtcgggcctccggggtcctaacnggttcagtggcagtggatcaggcacagtattttacactagaaaatcagcagagtgggagcgtgaggtagtggttggggttattactgcagtgacaagctctaaccactcgtgcggtacttcggcctgggaaccaaagttggagagtacaaacgacgttgttcggntgcaccattctgttcttaac

SEQ ID NO: 436835 - DNA, 515 bp, Homo sapiens
  misc_feature: GZ8MTXP01BJ8R3.13.6.A06.1.454.CMB.2.raw
  modified_base (257)..(257): a, c, t, g, unknown or other
  modified_base (331)..(331): a, c, t, g, unknown or other
  modified_base (496)..(496): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggatggtanctgcagaggccagggcagtccccacaactcctgatctattgggggttctaagtcgggcctccggggtccctaanggttcagtggcagtggatcaggcacagtatttacactagaaaatcagcaggagtggagctggaggtatggttgggttattactgcagtgcgaagctactacaacctctgcggtacttccggcctgggaaccaaagttggaagagtacgaaacgacgttggttggntcggcacattctcgttctc

SEQ ID NO: 436836 - DNA, 521 bp, Homo sapiens
  misc_feature: GZ8MTXP01D89TW.13.6.A06.1.454.CMB.2.raw
  modified_base (257)..(257): a, c, t, g, unknown or other
  modified_base (281)..(281): a, c, t, g, unknown or other
  modified_base (328)..(328): a, c, t, g, unknown or other
  modified_base (381)..(381): a, c, t, g, unknown or other
  modified_base (386)..(386): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggattggtanctgcagagccagggcagtccccanaactcctgatctattggggttctaatcgggcctcggggtcctaacgngttcagtggcagtggatcaggcacagattttacactagaaaatcagcagaggnggagngtagaggtagttggttagggttatagtgtacagtagacgaacgtactactactacctacgtcgtcgtacgttcgtccgtcggaacgaagagagagtacgtaacgacgttgttgcgtcgcactacttctcgttctc

SEQ ID NO: 436837 - DNA, 522 bp, Homo sapiens
  misc_feature: GZ8MTXP01BE9BH.13.6.A06.1.454.CMB.2.raw
  modified_base (284)..(284): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccanaactcctgatctattgggggttctaagtcgggcctccgggggtcctaagaggttcagtggcagtggatcgaggcacagtatttacactagaaaatcagcagagtggaggctggaggtatggttggggttattacgtgcagtgacaagctactacactcgtgccggtactttcggccctgggaaccaaaggttggagatacgaaacgacgttgttacgggctgcaccattctgttcttc

SEQ ID NO: 436838 - DNA, 539 bp, Homo sapiens
  misc_feature: GZ8MTXP01A2LT6.13.6.A06.1.454.CMB.2.raw
  modified_base (257)..(257): a, c, t, g, unknown or other
  modified_base (279)..(279): a, c, t, g, unknown or other
  modified_base (327)..(327): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggattggtanctgcagagcaggcagtccccanactctgatctagttggggttctaagtcgggcctccggggtcctaacgnggttcagtggcagtggatcgaggcacagtatttacactagaaatcagcagagtggaggctaggaggtagttgggtttaggggtttattacgtgacgagtgacgtaagtctactaaccaaccttcgtcggcggtaccgtttccgggcccgttaggggaacctaaaggttggaagatacgaaacgagttgttggctgcacctattctgttcttc

SEQ ID NO: 436839 - DNA, 566 bp, Homo sapiens
  misc_feature: GZ8MTXP01D6LA7.13.6.A06.1.454.CMB.2.raw
  modified_base (252)..(252): a, c, t, g, unknown or other
  modified_base (276)..(276): a, c, t, g, unknown or other
  modified_base (380)..(380): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagagcctctgcatagaaatgatatatattgattganctgcagagccaggcacgtccccanactctgatctagttggggttactaagtccgggcctccggggtaccctaagtaggttcaggtggacaggtggatcgaggcacagtatttacactagaaaatcagnaggagtggaggcgtaggaggtagttgggttaggggtttattacgtgtctagtggacaagtctactaccactcgtacgtcgtaccgttccggcccgtcgggaaccgtaaaggttggaacgttaacgtaacgaaaacgttaacgttggttacggtcgtcgaaccaacctgttcgtcgttcgttaaccg

SEQ ID NO: 436840 - DNA, 613 bp, Homo sapiens
  misc_feature: GZ8MTXP01A0WRC.13.6.A06.1.454.CMB.2.raw
  modified_base (283)..(283): a, c, t, g, unknown or other
  modified_base (334)..(334): a, c, t, g, unknown or other
  modified_base (391)..(391): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggcagggcacgtccccanactctgatctagttgggggttctaagtcgggcctccgggggtacctaacgnggttcagtggcagtggatcaggcacagtatttacactagaaatcagcagagtggagntaggaggtattgggtttagggttattacgtgactagtgacgtaagcttactaacctaaccgttcgtacggtccggttaaccgtttcccggggaccccgttaggggaaacccgtaaagggttacgggaaacggttaacgttaaaccggaaaacggttaaaccgttgggttacgggaacctacggaacccgtaccgtacgtttccttcggtttccctttaaccg

SEQ ID NO: 436841 - DNA, 628 bp, Homo sapiens
  misc_feature: GZ8MTXP01BTALS.13.6.A06.1.454.CMB.2.raw
  modified_base (259)..(259): a, c, t, g, unknown or other
  modified_base (283)..(283): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagcccggcctccatctcctgcaggtccagtcagagcctcctgcatagaaatggatataactattggattggtanctgcagaggcagggcagtccccanaactcctgatctagttgggggttctaagtcgggcctccgggggtccctaacgaggttcaggtggcagtggatcgagggcacgagtattttacatagaaaatcagcagaggtggaggcgtaggaggtagttggtttgggggtttaattacgtgggctaggtgacgaaacggcttacctaacctaaccttcgttacggccgggttacgttttcccggggcccgttacggggaacccgtaaagggttcggggaaacgttaacgttaaccgaaaaccggttaaaccgttgggttacgggtccgtacggttcccgaaccgttacttcgttcggtttcccgttttaacccg

SEQ ID NO: 436842 - DNA, 566 bp, Homo sapiens
  misc_feature: GZ8MTXP01BOM6I.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaatggatatactattggattggtatctgcagaggccagggcacgtccccacaactcctgatctagttgggggttactaagtccgggcctcccgggggtaccctaacgaggttcaggtggcaggtgatcaggcacagtatttacactagaaaatcagcaggagtgggaggcgtaggaggtattgggtttcggggtttattacgtgacagtgactaacgcttactaaccaaccgttcgtacggtcgggtaccttttccggcccgttagggggaacctaaagggttcggaagacttacgaaacgttacgttggttggctgccacacgttctcgttcttc

SEQ ID NO: 436843 - DNA, 643 bp, Homo sapiens
  misc_feature: GZ8MTXP01BL5G1.13.6.A06.1.454.CMB.2.raw
  modified_base (397)..(397): a, c, t, g, unknown or other
  modified_base (400)..(400): a, c, t, g, unknown or other
  modified_base (406)..(406): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagacgcctctgcatagaaatggatataactattggattggtatctgcagaggccgagggcacgtccccacactcctgatctagttgggggtactaacgtccgggtccgtccgggggtaccctaacgacggttcgaggtggctaggtggactcgaggcactagtatttacactagaaatcagnagngtgagngtagaggtattgggttacgggtttattacgtgtactaggtacgtacgtaaacgtccttaactaaccgtaaacccgttcgttaccgggtaccggttacccggttttacccgggccccggttacggggtaaacccgtaaagggttagggtaaacgttaacgtaaaccgtaaaacggttaacggttggttacgggaaccttacggcctaacccgtacgttccttcgtttaaccgtttccg

SEQ ID NO: 436844 - DNA, 635 bp, Homo sapiens
  misc_feature: GZ8MTXP01AIELW.13.6.A06.1.454.CMB.2.raw
  modified_base (257)..(257): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattgattggtanctgcagaggccagggcagtccccacaactcctgatctagttgggggttactaagtcgggcctccgggggtaccctaacgaggttcagtggcagtggatcaggcacagtattttacactagaaatcagacagaggtggaggctaggaggtagttgggtttagggggtttattaacgtggtacaagttgacgtaaagccttactaacctaaccgttcgtcggtccgggtaacctttccggggtaccccgttcgggggaaaccccgtaaaagggttacgggaaagggttaacgttaaaccgaaaacgggttaaacccgttggttacgggggtcccttgggtaaccaaccccgtaagtttccttcggtttccgtttaacccg

SEQ ID NO: 436845 - DNA, 544 bp, Homo sapiens
  misc_feature: GZ8MTXP01BJ6ES.13.6.A06.1.454.CMB.2.raw
  modified_base (256)..(256): a, c, t, g, unknown or other
  modified_base (281)..(281): a, c, t, g, unknown or other
  modified_base (359)..(359): a, c, t, g, unknown or other
  modified_base (384)..(384): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatgatataactattggattggtanctgcagaggccagggcagtccccanaactcctagatctagttgggggttctaagtccgggcctccggggtaccctaatggtcagtggcagtggatcgaggcanagtattttacactagaaaactcagnagagtggagcgtaggaggtattgggtttgggttattacgtgcagtgacaagctactaccaactcgtcggccgtacgtttccggcccgttgggaaacctaaggttaggagttactaacgaaacgacgttggttacggctgcctacattccgtgttccttcg

SEQ ID NO: 436846 - DNA, 580 bp, Homo sapiens
  misc_feature: GZ8MTXP01AXXVB.13.6.A06.1.454.CMB.2.raw
  modified_base (326)..(326): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggtctaatcggctcggggtcctaanggttcagtggcagtggatcagggcacagattttacactgaaaatcagcagagtggagctaggaggtatggttgggttattacgtgcagtgacgagtctctaaccaacttctcggtacggtaccgttttccgggcccgtacggggaaaccctaaagggttaggaagttacgtaaaccgaaacggttaaaccgttgggttccgggaacgttcgggtcccgaaaccgtacgtttacttcgggtttcccgtttaaccg

SEQ ID NO: 436847 - DNA, 606 bp, Homo sapiens
  misc_feature: GZ8MTXP01C1MFG.13.6.A06.1.454.CMB.2.raw
  modified_base (265)..(265): a, c, t, g, unknown or other
  modified_base (343)..(343): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagcccggcctccatctcctgcaggtccagtcagacgccctcctgcaataagaaatggataataactatttggattggtanctgcagaggcagggcagtccccacaactcctgatctagttgggggttctaagtccgggccgtccggggtaccctaacnggttcaggtggctaggtggatacgagggcaactagtaattttacactagaaaatcagcaggaggtggaggcgtagaggtagttgggtttaggggtttaattagtagacgtagttagacgaaagtcttactaaccaaccgttcgtacggtccgttacgtttccggcccgtaaggggtaaacccgtaaaggttgggaacgaacgtaaccgaaaacggttaacgttggttacggctcgaactacccattcgttcgttctttaaccg

SEQ ID NO: 436848 - DNA, 609 bp, Homo sapiens
  misc_feature: GZ8MTXP01AH91X.13.6.A06.1.454.CMB.2.raw
  modified_base (282)..(282): a, c, t, g, unknown or other
  modified_base (334)..(334): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccctggagagccggcctccatctcctgcaggtccagtcagagcctcctgcatagaaatggatataactattggattggtatctgcagaggccagggcagtccccanaactcctgatctagttgggggttctaagtcgggcctccgggggtcctaacgnggttcagtggcagtggatcaggcacagtatttacactagaaatcagcagagtggaggctaggaggtagttgggtttagggggtttattacgtgtacgagttgacgtaaagtccttactaacctaacccttcgttacggccggtaccgtttccgggccccgtaggggtaaccctaaaagggttcgggaagttaacgttaaccgaaaacggttaaccgttggttacggggccttacgggcccgtaaacccgttacgttaccgtttcgttccgttccg

SEQ ID NO: 436849 - DNA, 536 bp, Homo sapiens
  misc_feature: GZ8MTXP01CA17B.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctagttggggttctaagtcgggccgtccggggtccctaacgaggtcagtggcagtggatcaggcacagtattttacactagaaatcagcaggagtgggaggcgtaggaggtagttggtttggggtttattacgtgcagtgcaagctactacaaccgtctgccggtacttccggccgtcgggaaccaaaggttggagagtacgaaacgacgttggttaggctgcacgattcttgttcttaacc

SEQ ID NO: 436850 - DNA, 510 bp, Homo sapiens
  misc_feature: GZ8MTXP01A4NNV.13.6.A06.1.454.CMB.2.raw
  modified_base (284)..(284): a, c, t, g, unknown or other
  modified_base (380)..(380): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccanaactctgatctattgggggttctaatcgggcctccgggggtcctaacaggttcagtggcagtggatcaggcacagatttacatgaaaatcagcagngtggaggctagaggatggttggggttattacgtgcagtgcaagctctacaacctctgcgtactttcggcccgtgggaaccaaaggttgagatacaaacgacgttgttggcctgcaccattccttgttctc

SEQ ID NO: 436851 - DNA, 522 bp, Homo sapiens
  misc_feature: GZ8MTXP01AMLRY.13.6.A06.1.454.CMB.2.raw
  modified_base (284)..(284): a, c, t, g, unknown or other
  modified_base (291)..(291): a, c, t, g, unknown or other
  modified_base (335)..(335): a, c, t, g, unknown or other
  modified_base (380)..(380): a, c, t, g, unknown or other
  modified_base (382)..(382): a, c, t, g, unknown or other
  modified_base (384)..(384): a, c, t, g, unknown or other
  modified_base (391)..(391): a, c, t, g, unknown or other
  modified_base (396)..(396): a, c, t, g, unknown or other
  modified_base (421)..(421): a, c, t, g, unknown or other
  modified_base (423)..(423): a, c, t, g, unknown or other
  modified_base (499)..(499): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgcccggcctccatctcctgcaggtccagtcagagcctctgcatagaaatggatataactattggattggatctgcagaggccaggcacgtccccanactccgngatctagttgggggtctaagtcgggcctccggggtaccctaagnggttcaggtggcagtcggatcaggctacagtatttacatagaaanananagagagnggagngagagtagttggttggttagtagtntnagtgagactactactactactcgtcgtcgtcgttcgtccgacggaacgaagttaggagacgacgaacgacgttcgngcgtcgcactcttctcgttcgtc

SEQ ID NO: 436852 - DNA, 569 bp, Homo sapiens
  misc_feature: GZ8MTXP01B4U2C.13.6.A06.1.454.CMB.2.raw
  modified_base (256)..(256): a, c, t, g, unknown or other
  modified_base (387)..(387): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattgattggtanctgcagaggcaggcacgtccccacaactcctgatctagttgggggttactaagtccgggccgtccggggtccctaacgaggttcaggtggcagtggatacgaggcacagtattttacactagaaaatcagnaggagtggaggctaggaggtagttgggtttaggggtttactagtgactaggtggacaaagtcctacgtaacaacccgttgtcggcggtaccgtttccggccccgtggggaaacccgtaaaggttgggaagttagtaacgaaacgttacgttcgttgggaactcgcactattcgtgttcttcc

SEQ ID NO: 436853 - DNA, 530 bp, Homo sapiens
  misc_feature: GZ8MTXP01AJZSB.13.6.A06.1.454.CMB.2.raw
  modified_base (259)..(259): a, c, t, g, unknown or other
  modified_base (284)..(284): a, c, t, g, unknown or other
  modified_base (434)..(434): a, c, t, g, unknown or other
  modified_base (451)..(451): a, c, t, g, unknown or other
  modified_base (511)..(511): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagcccggcctccatctcctgcaggtccagtcagagcctcctgcatagaaatggatataactattggattggtanctgcagaggccagggcagtccccanactcctgatctagttgggggttctaagtccggggcctccgggggtaccctaacgaggttcagtggcagtggatcgaggcacagtattttacactagaaatcagcagagtggaggctaggaggtagtggttaggggttactagtgcgatgntaagtctactacacctntgcgtactttcggcccgtgggaacaaagttgggacagtacgaaacgttacgttgttcggntgctaccattctgttcttc

SEQ ID NO: 436854 - DNA, 504 bp, Homo sapiens
  misc_feature: GZ8MTXP01CBRGH.13.6.A06.1.454.CMB.2.raw
  modified_base (333)..(333): a, c, t, g, unknown or other
  modified_base (445)..(445): a, c, t, g, unknown or other
  modified_base (468)..(468): a, c, t, g, unknown or other
  modified_base (472)..(472): a, c, t, g, unknown or other
  modified_base (486)..(486): a, c, t, g, unknown or other
  modified_base (488)..(488): a, c, t, g, unknown or other
  modified_base (494)..(494): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctattggggttctaagtccgggcctccggggtcctaacgnggttcagtggcagtggatcgaggcacagtattttacactagaaatcagcaggagtggaggcgtaggaggtagttggttaggggtttattacgtgcagtgcagctctacactntgcgtcttcggcctggaacaagngagngtacaagacgttgngntgcacnttctgttctc

SEQ ID NO: 436855 - DNA, 601 bp, Homo sapiens
  misc_feature: GZ8MTXP01BDY82.13.6.A06.1.454.CMB.2.raw
  modified_base (281)..(281): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaatggatataactattggattggtatctgcagaggccagggcagtccccanaactcctgatctagttggggttctaagtccgggcctccggggtccctaagaggttcagtggcagtggatcaggcacagtatttacactagaaatcagcagagtggaggctaggaggtagtggtttaggggtttattacgtgactagtcgacgaagtcctactaaccaacccgttcgtacggtccggtaaccgtttcccgggaccccgttacggggaaacccgtaaaaggttcgggaaaggttaactaaccgtaaaacgttaaccgttggttacgggtaacctcggaacctacccgtattccttaacggttcctttaaccg

SEQ ID NO: 436856 - DNA, 582 bp, Homo sapiens
  misc_feature: GZ8MTXP01CST81.13.6.A06.1.454.CMB.2.raw
  modified_base (246)..(246): a, c, t, g, unknown or other
  modified_base (257)..(257): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctctgcatagaaatggatataactnttggattgtanctgcagaggccagggcacgtccccacaactcctgatctagttgggggttctaagtcgggcctccggggtccctaacgaggttcagtggcagtggatcaggcacagtaatttacactagaaaatcagcagagtggaggactggaggtagttggttgggtttatactgcagtgacaagtctactaaccaaccttctacggtccggtaccgtttccgggaccccgttaggggaaacccgtaaaggttcggggaaagttactaaaccgaaacggaaacgttggttacgggcgttacggaactaccctagttccttcgttaacctttccg

SEQ ID NO: 436857 - DNA, 577 bp, Homo sapiens
  misc_feature: GZ8MTXP01CAI94.13.6.A06.1.454.CMB.2.raw
  modified_base (255)..(255): a, c, t, g, unknown or other
  modified_base (281)..(281): a, c, t, g, unknown or other
  modified_base (324)..(324): a, c, t, g, unknown or other
  modified_base (373)..(373): a, c, t, g, unknown or other
  modified_base (390)..(390): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagcccggcctccatctcctgcaggtccagtcagagcctctgcatagaatggatatactattgattgtanctgcagaggccagggcacgtccccanactctgatctagttgggttctagtcggcctccggggtcctagngtcagtggcagtggatcgagcacagtatttacactagaaatcagcaggngtggagcgtaggaggtnttgggtttaggggtttattagtgactagtgacgtaagccttactacccaaccgttcgtcgggccggttcgtttccgggacccgttacggggaaccgtaaagggttgggaacgttaagttaaaccgaaacgttaacgttgggttacgggccttacggccctaacctgttccttcggttcctttaaccg

SEQ ID NO: 436858 - DNA, 538 bp, Homo sapiens
  misc_feature: GZ8MTXP01B12UO.13.6.A06.1.454.CMB.2.raw
  modified_base (258)..(258): a, c, t, g, unknown or other
  modified_base (395)..(395): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagcccggcctccatcctcctgcaggtccagtcagagcctcctgcatagaaatgatatactattggattggtanctgcagagccagggcacgtccccacaactcctgatctagttggggtactagtcgggcctccggggtcctaagtggtcaggtggcaggtggatcgaggcacgagtatttacactagaaaatcagcgagaggtggaggntaggaggtagttgggttgggtttatactgcagtgacgaagctacctaccaacgtcgtcgtccggtacgtttccggccgtggaacgaacgttgggagactaacgaacgttacgttggttaggctcgcaccattctcgttcttcc

SEQ ID NO: 436859 - DNA, 542 bp, Homo sapiens
  misc_feature: GZ8MTXP01C6QD9.13.6.A06.1.454.CMB.2.raw
  modified_base (258)..(258): a, c, t, g, unknown or other
  modified_base (332)..(332): a, c, t, g, unknown or other
  modified_base (343)..(343): a, c, t, g, unknown or other
  modified_base (347)..(347): a, c, t, g, unknown or other
  modified_base (391)..(391): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgcccggcctccatctcctgcaggtccagtcagagcctctgcatagaatggatataactattgattggtanctgcagaggcagggcagtccccaacaactcctgatctattggggttctaagtcgggcctccggggtcctaacgnggtcagtggcngtgntcgaggcacagtattttacactagaaatcagcaggaggtggagngtagaggtagttggtttggggttattacgtagctaggtgacaaaggcaaacacacgtcggtaccgtacgtacgtttggaccgtagggaaacccagcgttaggagagttcaaagttcgaacgtgttacggctcggcacctaagttcttaacg

SEQ ID NO: 436860 - DNA, 520 bp, Homo sapiens
  misc_feature: GZ8MTXP01DQNZI.13.6.A06.1.454.CMB.2.raw
  modified_base (258)..(258): a, c, t, g, unknown or other
  modified_base (280)..(280): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaatggatataactattggattggtanctgcagagcaggcagtccccanactctgatctattggggttctaagtcgggcctccggggtccctaacgaggttcaggtggcagtggatcgaggcacagtatttacactagaaaatcagcagagtggaggctagaggtattgggttagggttatacgtgcagtgacaaagctactaaccactcgtcgtcggtactttcggcccgtgggaacctaaaggttggagatacgaacgaacgttgagctagccacattctgttcttc

SEQ ID NO: 436861 - DNA, 612 bp, Homo sapiens
  misc_feature: GZ8MTXP01DA1SF.13.6.A06.1.454.CMB.2.raw
  modified_base (361)..(361): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgccggcctccatctcctgcaggtccagtcagacgcctcctgcataagaaatggataataactagtttggattggtatctgcaggacggccgagggccacgtccccaacaactcctgacttcgttagttgggggttactaacggtccggggccgttccgggggtaccctaacgnggttcaggtcggcaggtggatacgaggcactagtactttacatagaaaactcagcaggagtagggaggtgtaggtaggtagttgggtttagggtttatacgtagctagtcgacgtaacgtccttactaacctaccgttcgtcggtccggttaccgtttccgggaccgttagggaaacctaaagggttggaacgacgtaaacgaaacgttagttcggttcggctcgcctactattcgttcgttcgtttaacc

SEQ ID NO: 436862 - DNA, 534 bp, Homo sapiens
  misc_feature: GZ8MTXP01CQZQL.13.6.A06.1.454.CMB.2.raw
  modified_base (260)..(260): a, c, t, g, unknown or other
  modified_base (285)..(285): a, c, t, g, unknown or other
  modified_base (335)..(335): a, c, t, g, unknown or other
  modified_base (443)..(443): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatggatataactatttggattggtanctgcagaggccagggcagtccccanaactcctgatctattgggggttctaagtcgggcctccggggtccctaacnggttcagtggcagtggatcgaggcacagtattttacactagaaaatcagcaggagtggagcgtgaggtatggttgggttatacgtgcagtgacaagctactacacctntacgcgtactttcggccgtgggaaccaaaggttggagagtaacgaaacgttaacgttggttcggctgcacctattcttcgttctttaaccg

SEQ ID NO: 436863 - DNA, 536 bp, Homo sapiens
  misc_feature: GZ8MTXP01C5AMA.13.6.A06.1.454.CMB.2.raw
  modified_base (253)..(253): a, c, t, g, unknown or other
  modified_base (277)..(277): a, c, t, g, unknown or other
  modified_base (328)..(328): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcaccctggagagccggcctccatctcctgcaggtccagtcagagcctctgcatagaatgatatactattgattggtanctgcagaggcagggcagtccccanaactcctgatctagttggggttctaagtcgggccgtccggggtcctaacgnggtcaggtggcagtggatcgaggcacagtatttacactagaaatcagcagagtggagcgtagaggtatggttgggttatacgtgcagtgacgagctactacacttcgtacgcggtaccgtttccggcccgtgggaaaccaaaggttcgggaagactaacgaaaacgaacgttcggacggctgaactacctattctcgttctttaaccg

SEQ ID NO: 436864 - DNA, 602 bp, Homo sapiens
  misc_feature: GZ8MTXP01BIMQD.13.6.A06.1.454.CMB.2.raw
  modified_base (244)..(244): a, c, t, g, unknown or other
  modified_base (252)..(253): a, c, t, g, unknown or other
  modified_base (331)..(331): a, c, t, g, unknown or other
  modified_base (387)..(387): a, c, t, g, unknown or other
  modified_base (399)..(399): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgccggcctccatctcctgcaggtccagtcagacgcctctgcatagaatgatatatnttgatganngcagagcaggcacgtcccacactcctgatcgtagttgggggttactaacgtccgggtccgtccgggggtaccctaagnggttcaggtggacaggtggatacgaggcactagtactttacacttagaaaatcagnaggaggtggagngtaggaggtagttgggtttaggggttatacgtagatagtcggactaacgtctactaacctaaccgttcgtacggtccggtaccgtttccgggacccgtaggggtaaaccgtaaaggttagggaaagaaacgtaaaccgaaacggttaacgttggacggtccgttacggaacctaccgtagttccttcggtttaaccgtttccg

SEQ ID NO: 436865 - DNA, 578 bp, Homo sapiens
  misc_feature: GZ8MTXP01D32D3.13.6.A06.1.454.CMB.2.raw
  modified_base (253)..(253): a, c, t, g, unknown or other
  modified_base (329)..(329): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatgatatactattggatgtanctgcagaggcagggcacgtccccacaactctgatctattgggggttctaagtcggccgtccggggtaccctaacgnggttcagtggcagtggatcaggcacagtatttacactagaaaatcagcagagtggagctaggaggtagttggttaggggttattacgtgtcagtgacgtaagtcttacctactaacctcgtcggtcggttacgttttcggcccgtaggggaaaccctaaaggttcggtaagaacgttaaccgaaaacggttaacgttggttacgggtcttacggaacctaaccgtagttcccttgtttccgtttaaccg

SEQ ID NO: 436866 - DNA, 620 bp, Homo sapiens
  misc_feature: GZ8MTXP01ANKUK.13.6.A06.1.454.CMB.2.raw
  modified_base (295)..(295): a, c, t, g, unknown or other
  modified_base (420)..(420): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagacgcccggcctccatctcctgcaggtccagtcagacgcctcctgcaataagaaatggaatataactattggattggtatctgcaggaggccgagggccacgtccccaanacctctgatcgtagttgggggttactaacgtccgggtcccgtccggggtacctaagtcggttcaggtggcaggtggatacgaggcactagttatttacactagaaatcagacaggaggtggaggngtaggagtagttgggttagggttatacgtgctaggtcgacgtaatctacctaacctaaccgtcgtacggtaccggttacccgtttccgggacccggttaagggaaacccgaaaggttaggggtaaacaacgttaaaccggaaaacgttacgttggttacggcgtacgaacctaccgtacgttcgttcgttcctttaaccg

SEQ ID NO: 436867 - DNA, 566 bp, Homo sapiens
  misc_feature: GZ8MTXP01BR00N.13.6.A06.1.454.CMB.2.raw
  modified_base (253)..(253): a, c, t, g, unknown or other
  modified_base (275)..(275): a, c, t, g, unknown or other
  modified_base (323)..(323): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatgatatatattggattgtanctgcagagcaggcagtccccanactctgatctagttgggttctaagtcgggcctccgggggtacctaagnggttcaggtggcaggtggatcgaggtcacgtaagtattttacaactagaaaatcagacagagtggagctaggaggtattggttcggggttattacgtgacgagtgtacaagtcttactaaccaaccgtcgtacggcggttaaccgtttccggccccgttagggaacctaaaggttgggaacacgtaaacaaaacggttaacgttgttacggctcgaacctacctagttctcgttccttaaccg

SEQ ID NO: 436868 - DNA, 526 bp, Homo sapiens
  misc_feature: GZ8MTXP01AEDQW.13.6.A06.1.454.CMB.2.raw
  modified_base (258)..(258): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtanctgcagaggccagggcacgtccccacaactcctgatctattgggggtctaagtcgggcctccgggggtcctaacgaggttcaggtggcagtggatcgaggcacagtatttacactagaaaatcagcagagtggagctggaggtatggtttggggtttatacgtgcagtgacaagctactacaacctctgcggtactttccggcccgtgggaaccaaaggttggaagagtacgaaacgacgttgttcggctgccaccattctgttcttc

SEQ ID NO: 436869 - DNA, 510 bp, Homo sapiens
  misc_feature: GZ8MTXP01AKZXG.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctattgggggttctaagtcgggcctccgggggtccctaacaggttcagtggcagtggatcaggcacagattttacactgaaaatcagcagagtggagctgaggatggttggggttattactgcagtgcaaagctctacaacctctgcggtactttcggccctgggaaccaaagttggagatacaaacgacttgttaggctgcaccattctgttcttc

SEQ ID NO: 436870 - DNA, 509 bp, Homo sapiens
  misc_feature: GZ8MTXP01EEM68.13.6.A06.1.454.CMB.2.raw
  modified_base (285)..(285): a, c, t, g, unknown or other
  modified_base (338)..(338): a, c, t, g, unknown or other
  modified_base (440)..(440): a, c, t, g, unknown or other
  modified_base (489)..(489): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccaanactcctgatctagttgggggttctaacgttcgggcctccgggggtccctaagnggttcagtggcagtgatcaggcacagatttacatagaaaatcagcagagtggagcgtagaggtattggttgggttatacgtgcagtgcaagctactacactnagcgtacttccgctgggaaccaagttgagagtacgaaagacgttgttgntgcactattctgttcttaac

SEQ ID NO: 436871 - DNA, 570 bp, Homo sapiens
  misc_feature: GZ8MTXP01DU43O.13.6.A06.1.454.CMB.2.raw
  modified_base (263)..(263): a, c, t, g, unknown or other
  modified_base (342)..(342): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagcccggcctccatctcctgcaggtccagtcagacgcctcctgcaataagaaatggatataactatttggattggtanctgcagaggcagggcacgtccccaacaactcctgattctagttgggggttctaacgtcgggccgtccgggtccctaagnggttcagtggcagtgatcgaggcatagtaattttaacacttagaaaatcagcagagtagggaggtcgtaggaggtagttgggtttagggtttatacgtgcagtgactaaagtctactactaacctgtacggtcggtacgtttccgggaccgtagggaaccgaaaggttacggagaactaacgtaaacgaacgttggttaggtctagaacctactattctcgttcttcc

SEQ ID NO: 436872 - DNA, 543 bp, Homo sapiens
  misc_feature: GZ8MTXP01DUMRM.13.6.A06.1.454.CMB.2.raw
  modified_base (176)..(176): a, c, t, g, unknown or other
  modified_base (285)..(285): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtnacccctggagagccggcctccatctcctgcaggtccagtcagagcctcctgcatagaaatggatataactatttggattggtatctgcagaggccagggcagtccccanactcctgatctagttggggttctaagtcgggcctccgggggtccctaagaggttcagtggcagtggatcgaggctacagtattttacaatgaaaatcagcaggagtggagctaggaggtatgggttagggtttatacgtgctagtgtacaagtctactaactaaccttgtacggcggtacgtttcggcccgttgggaaccaaggttcgaagttatacgaaagacgttggttggaactgaacacctattcgtgttcttc

SEQ ID NO: 436873 - DNA, 518 bp, Homo sapiens
  misc_feature: GZ8MTXP01EK4DC.13.6.A06.1.454.CMB.2.raw
  modified_base (283)..(283): a, c, t, g, unknown or other
  modified_base (332)..(332): a, c, t, g, unknown or other
  modified_base (344)..(344): a, c, t, g, unknown or other
  modified_base (357)..(357): a, c, t, g, unknown or other
  modified_base (378)..(378): a, c, t, g, unknown or other
  modified_base (496)..(496): a, c, t, g, unknown or other
  modified_base (506)..(506): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctctgcatagaaatggatataactattggattggtatctgcagaggccagggcagtccccanaactcctgatctattgggggttctaagtcgggcctccgggggtcctaanaggttcagtggnagtgatcaggcanagatttacactagaaatcagnagagtggaggctaggaggtattggttagggttattacgtgcagtgcaaagctactaacaacctcgtagcggtacttcggcccgtgggaaccaaggttggagatacgaaacgacgttgnggctgcaacnttctcgttcttc

SEQ ID NO: 436874 - DNA, 590 bp, Homo sapiens
  misc_feature: GZ8MTXP01B479G.13.6.A06.1.454.CMB.2.raw
  modified_base (280)..(280): a, c, t, g, unknown or other
  modified_base (329)..(329): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatatactattgattggtatctgcagaggcagggcacgtccccanactcctgatctagttggggttctaagtcgggccgtccgggtcctaacgngttcagtggcagtgatcaggcactagtatttacactagaaatcagcaggagtggagcgtaggaggtattgggttaggggtttattacgtgacgtagtcgacgtaaacgtcttacctaacctaacccgttcgtacggtccggttaaccgtttccggggaccccgttagggggaaaccctaaagggttggaaacgttacttaaacgaaacggttaacgttcggttacgggtctcggaacaacccgtcttccgttgttccttcg

SEQ ID NO: 436875 - DNA, 587 bp, Homo sapiens
  misc_feature: GZ8MTXP01DTMLP.13.6.A06.1.454.CMB.2.raw
  modified_base (256)..(256): a, c, t, g, unknown or other
  modified_base (278)..(278): a, c, t, g, unknown or other
  modified_base (324)..(324): a, c, t, g, unknown or other
  modified_base (349)..(349): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctcatctcctgcaggtccagtcagagcctctgcatagaaatggatataactattggattggtanctgcagagcaggcagtccccanactctgatctagttgggttctaagtcgggcctccggggtccctaanggttcagtggcagtggatcgagcanagtatttacatagaaatcagcagagtggagcgtagagggtattgggttaggggttacttagtgactaggtagtacgaacggtacttacctaactaacccgttcgtcggtacccggtaaccgttttcccgggcccgttaaggggaaccctaaaagggttcgggaaaggttaaacttaacgaaaacggttaaccgttggttacgggtctacggcaacccgtattcttcgttcgtttaacc

SEQ ID NO: 436876 - DNA, 539 bp, Homo sapiens
  misc_feature: GZ8MTXP01E0ZLU.13.6.A06.1.454.CMB.2.raw
  modified_base (257)..(257): a, c, t, g, unknown or other
  modified_base (282)..(282): a, c, t, g, unknown or other
  modified_base (332)..(332): a, c, t, g, unknown or other
  modified_base (380)..(380): a, c, t, g, unknown or other
  modified_base (414)..(414): a, c, t, g, unknown or other
  modified_base (423)..(423): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggattggtanctgcagaggccagggcagtccccanaactcctgatctagttgggggttctaagtcgggcctccggggtcctaagnggttcagtggcagtggatcgaggcacagtatttacactagaaaatcancagagtggagctaggaggtatgggttcgggttanattacgtgntaagtggacaagctactacaacctctacggtcggtactttccggccgtgggaaaccaaaggtggaagtaactacgaaaacgttacgttggtaacgcttcgactaccatcttgttcc

SEQ ID NO: 436877 - DNA, 532 bp, Homo sapiens
  misc_feature: GZ8MTXP01AGT6Q.13.6.A06.1.454.CMB.2.raw
  modified_base (245)..(245): a, c, t, g, unknown or other
  modified_base (284)..(284): a, c, t, g, unknown or other
  modified_base (449)..(449): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactntttggattggtatctgcaggaggccagggcagtccccanactcctgatctagttggggtctaagtcgggacctccgggggtccctaagaggttcaggtggacagtggatcgaggcacagtatttacactagaaatcagcaggagtgggagctaggaggtattgggttagggtttatacgtgcagtgactagctctactaccgtntaggcgtacttcggccgtgggaaccaaggttggaacgatacgaaacgagttcgttggaactgaaccacctattctcgttcttc

SEQ ID NO: 436878 - DNA, 570 bp, Homo sapiens
  misc_feature: GZ8MTXP01DEE10.13.6.A06.1.454.CMB.2.raw
  modified_base (256)..(256): a, c, t, g, unknown or other
  modified_base (280)..(280): a, c, t, g, unknown or other
  modified_base (325)..(325): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggattgtanctgcagagccaggcacgtccccanaactctgatctagttgggtctaagtcggcctccgggtcctaacgnggttcagtggcaggtggatacgaggcactagtactttacactagaaatcagcagaggtggaggcgtaggaggtattgggtttagggttatacgtgacagtgacaagtctactaacgaaccttcgtacggccggtacgtttccgggcccgttaggggaaaccctaaaggttggaagaacgttaacgaaaacggttaacgttggttacggtctacgctaacccgtattccgttcgttccgttaaccg

SEQ ID NO: 436879 - DNA, 574 bp, Homo sapiens
  misc_feature: GZ8MTXP01B300L.13.6.A06.1.454.CMB.2.raw
  modified_base (255)..(255): a, c, t, g, unknown or other
  modified_base (281)..(281): a, c, t, g, unknown or other
  modified_base (392)..(392): a, c, t, g, unknown or other
  modified_base (397)..(397): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagacgcctctgcatagaatgatatactattggattggtanctgcagagccgaggccacgtccccanactcctgatcttagttcggggttctaacgtccgggccgtccgggtacctaagtggttcaggtggcaggtggatcgagcactagttatttacatagaaatcagcgaggaggnggagngtaggaggtagttgggtttagggttattcgtgcaagtcgacgtaagtctacctaactaccgtcgtcggccgttacgttccggccgtagggaaaccgtaaaggttggaagttaacgtaaccgaaacggttacgttggacggtctacgaacctacctagttccgttcgttcctttaacc

SEQ ID NO: 436880 - DNA, 545 bp, Homo sapiens
  misc_feature: GZ8MTXP01AQ7CC.13.6.A06.1.454.CMB.2.raw
  modified_base (259)..(259): a, c, t, g, unknown or other
  modified_base (284)..(284): a, c, t, g, unknown or other
  modified_base (495)..(495): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtanctgcagaggccagggcagtccccanactcctgatctattgggggttctaagtcgggcctccgggggtccctaacgaggttcaggtggcagtggatcaggcacagtattttacactgaaaatcagcagagtggaggcgtgaggtattggttagggtttattacgtgacagtgacaagctactacaaccttctacggccggtactttccggcccgttgggaacccaaaggttgggaanagtaaccgaaacgaacgttggacggctgccactacttctcgttcttaacc

SEQ ID NO: 436881 - DNA, 765 bp, Homo sapiens
  misc_feature: GZ8MTXP01DO39D.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgccggcctccatctcctgcaggtccagtcagacgcctctgacaataagaaatggaattaataaacttagtttggattggtatcgtgcgaggacggccgagggccacgtccccaaacaacctcctagtacttacgttaggtttcgggggttactaacgggttcccgggggtccccggttacccgggggtacccttaaacggtgggtttaccgaagggttcgggacgtagggtcggtaactaaccggaacgggtaacctaaacgtaaaggtttaaactttttaaaccgaacgttaaaggaaaaaactccgaagtacgaagggtaagggttagggaggtacgtagggtaagggttagtttacggggtttaggggtttaacttaacgtgtacgtaaggttcgaacgtaaacgtcccttaacctaaccgtaacccgttcgtacgggtccggttaaccgtttcccgggaacccggtagggaaaacccgtaaagggttacggaaacgttaacgtaaacgtaaacggttaacgttcgggttacgaactacgaacctaccgtacttcgttcgttccgtttaacccg

SEQ ID NO: 436882 - DNA, 588 bp, Homo sapiens
  misc_feature: GZ8MTXP01CWCMV.13.6.A06.1.454.CMB.2.raw
  modified_base (346)..(346): a, c, t, g, unknown or other
  modified_base (525)..(525): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagacgccctcctgcataagaaatggataataactatttggattggtatctgcagaggcaggcacgtccccaacaactcctgatcttagttggggttctaagtccgggccgttccgggggtaccctaacgnggttcaggtggcagtggatacgaggcagagtaatttacactagaaaatcagcaaggagtagggaggtcgtagggtagggtagttagggtttaggggtttaattacgtagctaagtcggactaaagcttactacaaccttgtacggccggttacgttcgggccgtagggaacctaaaggnggtaagacgtaacgaacggttaacgttggttacggctcgaactacgattcgtcgttcttaacc

SEQ ID NO: 436883 - DNA, 703 bp, Homo sapiens
  misc_feature: GZ8MTXP01B1BZ5.13.6.A06.1.454.CMB.2.raw
  modified_base (369)..(369): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgccggcctccatctcctgcaggtccagtcagacgcctctgcaataagaaatggaattaataacttattggtattggtatctgcaggaggccgagggcacgtccccaactaacctcctagacttcgttaagttcgggggtttactaacggtccgggtccgttacccggggtaccctaaacgnggttacgaggtcggactaggtcggaatcgaagggtcaaagtaagtaacttttaacaacgtaagaaaaacgtcaagacgaaggtaggtgggaaggtgtagggtaggtaagttgggtttaggggttactttacgtagtactaaggtcgtacgtaaacgtccttaacgtaaccaaacccgttcgttaccgggtaaccggttaacccgttttcccggggaccccgttaacggggaaacccgtaaaagggttgggaaacgttaacgtaaaccgtaaaacgttaaccggttgggttacggaaccgtcgaactacccgtattccgtcgttcgtttaacccg

SEQ ID NO: 436884 - DNA, 558 bp, Homo sapiens
  misc_feature: GZ8MTXP01BA9K1.13.6.A06.1.454.CMB.2.raw
  modified_base (244)..(244): a, c, t, g, unknown or other
  modified_base (256)..(256): a, c, t, g, unknown or other
  modified_base (281)..(281): a, c, t, g, unknown or other
  modified_base (398)..(398): a, c, t, g, unknown or other
  modified_base (410)..(410): a, c, t, g, unknown or other
  modified_base (461)..(461): a, c, t, g, unknown or other
  modified_base (547)..(547): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaatggatataactnttggattggtanctgcagaggccagggcagtccccanaactcctgatctagttgggggttctaagtccgggcctccgggggtaccctaatcgggtttcaggttggcaggtggatccgaaggcaacaggttattttacacgtagaaaactcaagnagaggtggaggntaggaggtatggttagggttactagtgcatgcaagtctactaacacccgtntacggtcgtacctttcggccccgtgggaacctaaggttggagacgttaacaaaacgttacgttaggttggtaacctgcctaacctnttctcgttctc

SEQ ID NO: 436885 - DNA, 564 bp, Homo sapiens
  misc_feature: GZ8MTXP01D4L8J.13.6.A06.1.454.CMB.2.raw
  modified_base (336)..(336): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctagttggggttactaagtcgggcctccgggggtacctaacgnggttcagtggacaggtggatacgagcacagtaactttacactagaaatcagcagagtggagctagaggtatggtttggggttattactgctagtcgctaaagctactacctaacctcgtacggtcggtacgtttccggtacccgtcgggaaaccgtaaagggttaggacggaactacgtaaaacggaacgttggttacggctacgcaccagttctcgttctttaaccg

SEQ ID NO: 436886 - DNA, 513 bp, Homo sapiens
  misc_feature: GZ8MTXP01AMWC0.13.6.A06.1.454.CMB.2.raw
  modified_base (284)..(284): a, c, t, g, unknown or other
  modified_base (333)..(333): a, c, t, g, unknown or other
  modified_base (420)..(420): a, c, t, g, unknown or other
  modified_base (493)..(493): a, c, t, g, unknown or other
  modified_base (503)..(503): a, c, t, g, unknown or other
  modified_base (509)..(509): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccanaactcctgatctagtggggttctaagtcgggcctccgggggtcctaacnggttcagtggcagtggatcaggcacagtatttacatagaaaatcagcagagtggaggctaggaggtatggttaggggtttattacgngcagtgacaagctactaccactctgcgtacttcggccgtggtaaccaaaggttgacgatacgaaagacttggngctgcactanctgttnttcc

SEQ ID NO: 436887 - DNA, 571 bp, Homo sapiens
  misc_feature: GZ8MTXP01DAUF6.13.6.A06.1.454.CMB.2.raw
  modified_base (254)..(254): a, c, t, g, unknown or other
  modified_base (277)..(277): a, c, t, g, unknown or other
  modified_base (282)..(282): a, c, t, g, unknown or other
  modified_base (323)..(323): a, c, t, g, unknown or other
  modified_base (389)..(389): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccgtggagacgccggcctcatctcctgcaggtccagtcagacgcctctgcatagaatgatataatattgattgtanctgcagagcaggcacgtccccanactcngatctagttgggtactagtccggccgtccgggtacctaagnggttcaggtggacagtggatacgaggcactagttatttacacgtagaaatcagcaggagtggaggngtaggaggtagttgggttacgggtttatacgtgactagtcgacaacgtctactaacctactcgtacgtccggtccgtttccgggcccgttagggaaaccgtaaggttaggtaacgaacgtaaacgtaaaccggttaacgttggttacggtctacgcctaaccttacttacgttcgttcgttc

SEQ ID NO: 436888 - DNA, 494 bp, Homo sapiens
  misc_feature: GZ8MTXP01BPE2V.13.6.A06.1.454.CMB.2.raw
  modified_base (255)..(255): a, c, t, g, unknown or other
  modified_base (278)..(278): a, c, t, g, unknown or other
  modified_base (325)..(325): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatatactattggatggtantgcagagccagggcagtccccanaactcctgatctattggggtctaagtcgggcctccggggtcctaagnggttcagtggcagtggatcaggcacagtatttacactagaaatcagcagagtggagctgaggatggttagggttatacgtgcagtgcaagctcacactctgcgtacttcggccgtggaacaagttggagagtacgaacgacgttgttggctgcaccgattctgttcttc

SEQ ID NO: 436889 - DNA, 595 bp, Homo sapiens
  misc_feature: GZ8MTXP01B2I9W.13.6.A06.1.454.CMB.2.raw
  modified_base (254)..(254): a, c, t, g, unknown or other
  modified_base (281)..(281): a, c, t, g, unknown or other
  modified_base (333)..(333): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagacgcctctgcatagaaatgatatatattgattgganctgcagaggccagggccacgtccccanaactcctgatctagttgggggttctaagtcgggcctccgagggtccctaagnggttccaggtgcagtggaatcgaaggcacgagtactttacacttagaaaactcagcgaaggaggtaggagggacgtagggaggtagttggtttaggggtttattacgtgacgtagtaggacaaacggtcctacgtaacctaaccgttcgtcggtccggtaccgtttccgggcccgtaaggggtaaccgaaagggtggaacgtaacgtaacgaaacggttaacgttaggtcggctcggtaccaccgttatccgttgtttaacc

SEQ ID NO: 436890 - DNA, 607 bp, Homo sapiens
  misc_feature: GZ8MTXP01EGZ1V.13.6.A06.1.454.CMB.2.raw
  modified_base (248)..(248): a, c, t, g, unknown or other
  modified_base (260)..(260): a, c, t, g, unknown or other
  modified_base (284)..(284): a, c, t, g, unknown or other
  modified_base (334)..(334): a, c, t, g, unknown or other
  modified_base (387)..(387): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgccggcctccatctcctgcaggtccagtcagagcctcctgcaatagaaatgatataactnttggattggtanctgcagagcagggcacgtccccanactctgattctagttgggttactaagtccgggcctccggggtccctaagnggttcagtggcagtgatcgaggcactagtatttacaacttagaaaatcacganaggaggtagggaggtcgtaggtagggtagttgggtttaggggtttacttacgtgtactaggttcgacgtaaagtccttactaaccgtaaccgttcgtacgggtccggttaccgtttcccgggacccgttacggggaaacctaaagggttaggaaacgttaacgtaacgaaaacgttacgttggttacggctagaacctacctattcttaacgttcttaac

SEQ ID NO: 436891 - DNA, 578 bp, Homo sapiens
  misc_feature: GZ8MTXP01EIYZW.13.6.A06.1.454.CMB.2.raw
  modified_base (257)..(257): a, c, t, g, unknown or other
  modified_base (284)..(284): a, c, t, g, unknown or other
  modified_base (331)..(331): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcaccccgtggagacgccggcctccatctcctgcaggtccagtcagagcctctgcatagaatggatatactattgattggtanctgcagaggccagggcacgtccccaanactcctgatctagttggggttctacgtcggccgtccgggtccaacgnggttcagtggcagtggatcgagcactagtatttacactagaaatcagcagagtggagcgtaggaggtagttggttaggggttattacgtagtcgtaggttgacgtaagtccttacctaacctaaccgttcgtacggtccggttaccgtttccgggacccgttaggggaaccctaaaggttacggaagaactaccgaaaacgttacgttggttacggtctacgctacccattcttcgttcctttaacc

SEQ ID NO: 436892 - DNA, 742 bp, Homo sapiens
  misc_feature: GZ8MTXP01AZNXT.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgcccggcctccatctcctgcaggtccagtcagacgcctctgcaataagaaatgaataataacttagtttggaattggtatcgtgacaggacggccgagggccacgtccccaataacctcctagacttcgttaggtttcggggttactaacggtccgggtcccggttccggggttaccctaaagtcggttcaaggtggacaggtggaactcgaacgggtcaaacgtaagttacttttaacgacgtaaggtaaaaactccgaagacgtaaggagggttacgggaagggtagttagggtaagggttagtttaggggtttaggggttttaactaacggtgtacgtaagttcgggaactaacggtaccttaccgtaaccgtaaccgttcgtaccgggtaccggttaacccggtttcccgggaccccggttaaggggaaacccgtaaagggttcgggtaaacggttaacgttaaaccgtaaaacgggttaacgttcgggttaccgggtcctacgggtaaccctaccggtacttcccggttaacgtttcccgtttaacccg

SEQ ID NO: 436893 - DNA, 539 bp, Homo sapiens
  misc_feature: GZ8MTXP01EWFJ2.13.6.A06.1.454.CMB.2.raw
  modified_base (260)..(260): a, c, t, g, unknown or other
  modified_base (284)..(284): a, c, t, g, unknown or other
  modified_base (289)..(289): a, c, t, g, unknown or other
  modified_base (330)..(330): a, c, t, g, unknown or other
  modified_base (388)..(388): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggagtccagtgggaatattgtgatgactcagtctccactctacctgccccgtcacccctggagagccggcctccatctcctgcaggtccagtcagagcctctgcatagaaatggatataactattggattggtanctgcagagccaggcacgtccccanactcngatctagttggggtctaagtcgggcctccggggtcctaagnggttcaggtggcaggtgatcagcacagtatttacactagaaatcagcaggagtggagngtaggagtgttggttagggttattacgtgctagtgacaagtctactaacacctcgtcggtcgtacgttcggcccgtaggggaacctaaaggttggacgaagtaacaaacggttacgttggttcggctgccactattcgttcgttcgtttcc

SEQ ID NO: 436894 - DNA, 583 bp, Homo sapiens
  misc_feature: GZ8MTXP01EPIGT.13.6.A06.1.454.CMB.2.raw
  modified_base (248)..(248): a, c, t, g, unknown or other
  modified_base (252)..(252): a, c, t, g, unknown or other
  modified_base (256)..(257): a, c, t, g, unknown or other
  modified_base (262)..(262): a, c, t, g, unknown or other
  modified_base (330)..(330): a, c, t, g, unknown or other
  modified_base (371)..(371): a, c, t, g, unknown or other
  modified_base (377)..(377): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgccccgtcacccctggagacgccggcctccatctcctgcaggtccagtcagacgcctcctgcataagaatggatatatnttgntgtnngcagngcaggcacgtcccacactctgatcttagttgggttactaagtccgggccgtccggggtaccctaacgnggttcagtggcgaggtgatcgagcatagtactttacactanaaactnagacgaggaggtgggagcgtaggagggttagttggggtttagggtttaattacgtgtaccgtaggtcgtacgtaaacgtcttacctaaacctaccgttgttacggtccggttaccgttcccgggcccgtagggaaaccgtaagttacggaagttaactaacgaaacgttacgttgacgtctacgcctacattcgtcgtttcgttcc

SEQ ID NO: 436895 - DNA, 575 bp, Homo sapiens
  misc_feature: GZ8MTXP01DGD6R.13.6.A06.1.454.CMB.2.raw
  modified_base (260)..(260): a, c, t, g, unknown or other
  modified_base (339)..(339): a, c, t, g, unknown or other
  modified_base (351)..(351): a, c, t, g, unknown or other
  modified_base (549)..(549): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagacgcctcctgcatagaaatggatataactattggattggtanctgcagaggccagggcagtccccacaactcctgatcttagttggggttctaacgtcggggcctccggggtaccctaagnggttcagtggcngtgatcgagcacagttaatttacactagaaaactcagcgaaggaggtgggaggtcgtaggagggttagtttggggtttacggggtttaattaacgtgtacgaaggttgacgtaaagtcctactaaccaacctcgtacggtcgtacgtttccggccgtgggaactaaaggttggaagagtaacgaagacgttgttcggntacgcacctagttctcgttcttaacc

SEQ ID NO: 436896 - DNA, 508 bp, Homo sapiens
  misc_feature: GZ8MTXP01BC02M.13.6.A06.1.454.CMB.2.raw
  modified_base (256)..(256): a, c, t, g, unknown or other
  modified_base (331)..(331): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaatggatataactattggattggtanctgcagaggccagggcagtccccacaactcctgatctagttgggggtctaagtcgggcctccggggtccctaagnggttcagtggcagtggatcgaggcaacagtattttacactgaaaatcagcgagggtgaggctggaggatgttagtggctgtattattggcatgacaagcaacacactggtccgtactacgtttggcctaggggaccagcgtaggagattcaatcgactgtggcttcgcgaaccgtaa

SEQ ID NO: 436897 - DNA, 592 bp, Homo sapiens
  misc_feature: GZ8MTXP01A1OMB.13.6.A06.1.454.CMB.2.raw
  modified_base (244)..(244): a, c, t, g, unknown or other
  modified_base (248)..(248): a, c, t, g, unknown or other
  modified_base (252)..(253): a, c, t, g, unknown or other
  modified_base (255)..(255): a, c, t, g, unknown or other
  modified_base (274)..(274): a, c, t, g, unknown or other
  modified_base (324)..(324): a, c, t, g, unknown or other
  modified_base (390)..(390): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgcccggcctccatctcctgcaggtccagtcagacgcctctgcatagaatgatatatnttgntgtnngnagagcaggcacgtccccanactctgatctagttgggttactagtccgggccgtccggggtaccctaagnggttcaggtggcagtggatcgaggcactagtacttttacagtagaaaatcagcaggaggtgggagngtaggaggtagttgggtttaggggtttattacgtgactaggtacgacgtaaacgtccttaacctaaccgtaaccgttcgtacggtccggttacccgtttccgggacccggtaggggaaaccgtaaaggttgggaacgttaacgtaaaccgaaacgttacgttggttcggctacgaacctacctagttccttcgttcgttccg

SEQ ID NO: 436898 - DNA, 527 bp, Homo sapiens
  misc_feature: GZ8MTXP01ALXYQ.13.6.A06.1.454.CMB.2.raw
  modified_base (259)..(259): a, c, t, g, unknown or other
  modified_base (283)..(283): a, c, t, g, unknown or other
  modified_base (288)..(288): a, c, t, g, unknown or other
  modified_base (327)..(327): a, c, t, g, unknown or other
  modified_base (510)..(510): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagatccggcctccatctcctgcaggtccagtcagagcctcctgcatagaaatggatataactatttggattggtanctgcagaggccaggcagtccccanactcngatctattggggtctagtcgggcctccggggtacctagnggttcaggtggcaggtggatcgagggcacagtattttacactagaaaatcagcaggagtgggaggctaggaggtagttggtttaggggttatacgtgcagtgacagctactacacctcgtgcgtacttcgccgtggggaaccaaggttgagttacgtacgaaacgacgttggttaggctgccnctattctcgttcttaac

SEQ ID NO: 436899 - DNA, 607 bp, Homo sapiens
  misc_feature: GZ8MTXP01EUT3Y.13.6.A06.1.454.CMB.2.raw
  modified_base (260)..(260): a, c, t, g, unknown or other
  modified_base (286)..(286): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatggatataactatttggattggtanctgcagaggccagggcacgtccccanaactcctgatcttagttgggggttactaagtcgggccgtccggggtacctaacgaggttcagtggcaggtgatcaggcagagtatttacatagaaatcagcagagtggaggcgtagaggtagtggttaggggttattacgtgactagtgacgtaacgtactacctaacctaacctcgttcggccggtaccgtttccgggcccgttacggggaaccgtaaagggttacgggaagttaacgtaacgtaaaacggttaaaccgttgggttacgggtcgttacggaaccgtaacccgtacgtttaccttcggtttccgttttccg

SEQ ID NO: 436900 - DNA, 693 bp, Homo sapiens
  misc_feature: GZ8MTXP01CKQHU.13.6.A06.1.454.CMB.2.raw
  modified_base (266)..(266): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtggaatattgtgatgactcagtctccactctacctgcccgtcacccgtggagacgcccggcctccatcctcctgcaggtccagtcagacgcctctgacataagaatggaatataaacttgtttaggattggtancgtgacgaggacggccgagggcctacgtacccccaataaacctcctagtacttacgttaggtttgggggtacctaagtcccgggccttaccgacgggttacccctaaagtcggtttacccagggttggactaggtacggaacttcgaacgggactaactaaaggtttaactttaacgaacgttaagaaaactacgagtacgaagggtacggtagggagggtacgttagggtagggttaggtttagggtttaggggttttaactacggttgtacgttagtacggaactaagtccttaaccgtaacctaacgttcgtcggtaccgttaccggtttccggaccggtaacggtaaacgttaaaggtggaacgtaacgtaacgaaacggttcttaggtccggctcgactacgttacttcgttcgtttaaccc

SEQ ID NO: 436901 - DNA, 604 bp, Homo sapiens
  misc_feature: GZ8MTXP01A7EDU.13.6.A06.1.454.CMB.2.raw
  modified_base (256)..(256): a, c, t, g, unknown or other
  modified_base (278)..(278): a, c, t, g, unknown or other
  modified_base (330)..(330): a, c, t, g, unknown or other
  modified_base (355)..(355): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagagccggcctccatctcctgcaggtccagtcagagcctctgcatagaatgatatactattggattgtatcngcagaggcaggcacgtccccanactcctgatctagttggggtactaacgtcgggtcctccggggtaccctaagnggttcagtgggcaggtgatcagcanagtatttacactagaaatcagcagagtggaggcgtaggaggtagttgggtttaggggttattagtgtactagtagacgtaacgcttacctaaactaaccgttcgttacggtaccggttaccgttttacccgggcccgttaacggggaaacccgtaaagggttacgggaaaggttaacttaaaccgaaacggttaaccgttgggttacgggtctacggaacctaccgtagttctttcgttcctttaaccg

SEQ ID NO: 436902 - DNA, 524 bp, Homo sapiens
  misc_feature: GZ8MTXP01ARXXA.13.6.A06.1.454.CMB.2.raw
  modified_base (283)..(283): a, c, t, g, unknown or other
  modified_base (334)..(334): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccanactcctgatctattgggggttctaagtcgggcctccgggggtccctaacgnggttcagtggcaggtggatcaggcacagtatttacactagaaaatcagcagagtggagctgaggtatggttaggggttatacgtgctagtgcaagctactacaactctgcgtacgtttcggaccgtgggaaccaaggttcggaagacgtacgaaacgacgttgcggtctgccacattcctgttcttaacc

SEQ ID NO: 436903 - DNA, 627 bp, Homo sapiens
  misc_feature: GZ8MTXP01A4RUY.13.6.A06.1.454.CMB.2.raw
  modified_base (297)..(297): a, c, t, g, unknown or other
  modified_base (478)..(478): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgcccggcctccatctcctgcaggtccagtcagacgcctctgcaatagaaatgatataacttagtttggattggtatctgacaggacggccgagggccacgtacccccaanaacctcctagtactacgttagttcgggggttactaacggtccgggtccgttacccggggtacctaagcggtcgacggtggacgtaggtggactacgaggctaacgtaagtacttttaaccgataagaaaactcgaagcgaggaggtggaggctaggagtgttagggtttagggttactagngtacgagtgactaagcttacacctaacgttcgtacggtccgttacggttcccggaccggtacggaaaccgtaaggttagggaacaagttaaaccgaacgttacgttcggcgggtcctacgaaccaccgtattcgtcgttcccttaaccg

SEQ ID NO: 436904 - DNA, 503 bp, Homo sapiens
  misc_feature: GZ8MTXP01AP0N3.13.6.A06.1.454.CMB.2.raw
  modified_base (247)..(247): a, c, t, g, unknown or other
  modified_base (258)..(258): a, c, t, g, unknown or other
  modified_base (260)..(260): a, c, t, g, unknown or other
  modified_base (265)..(265): a, c, t, g, unknown or other
  modified_base (281)..(281): a, c, t, g, unknown or other
  modified_base (326)..(326): a, c, t, g, unknown or other
  modified_base (385)..(385): a, c, t, g, unknown or other
  modified_base (439)..(439): a, c, t, g, unknown or other
  modified_base (466)..(466): a, c, t, g, unknown or other
  modified_base (483)..(483): a, c, t, g, unknown or other
  modified_base (492)..(492): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagagcctcctgcatagaaatggatataactnttggattggancngcagngccaggcacgtcccanactctgatctagttgggtactaagtcggccgtccgggtcctaagnggttcagtgcagtgatcaggcaatagtatttacactagaaaatcagcaggagtggaggngtaggaggtacttgggtttgggttattacgtagcagtgacagtctactacactncgcgtctcggcctggaacaagttgganagaacgaacgacgttgngctgcactnttctcgttctc

SEQ ID NO: 436905 - DNA, 646 bp, Homo sapiens
  misc_feature: GZ8MTXP01BBP2R.13.6.A06.1.454.CMB.2.raw
  modified_base (241)..(241): a, c, t, g, unknown or other
  modified_base (244)..(244): a, c, t, g, unknown or other
  modified_base (247)..(249): a, c, t, g, unknown or other
  modified_base (251)..(251): a, c, t, g, unknown or other
  modified_base (254)..(254): a, c, t, g, unknown or other
  modified_base (269)..(269): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagcgcctctgcatagaatgatatatntgntgnnngnagngcaggcacgtcccanactctgatcgtagttgggtactacgtccggccgtccgggtacctaagtggtcaggtggacgtaggtggatacgacggcaacgtagttaactttacaacgttaagaaaactcgagacgaaggtagggtagggaaggtgttaagggtaagggttagtttacgggggttttaaggggtttaacttaacggtgtacgtaagggttcggaaccgtaaacgtcccttaaacctaaaccgtaacccgttcggtaccgggtaccgggttaacccgtttcccggggaacccggttaacggggaaaccgtaaagggttgggaaacttaacgtaaacgaaaacgttcggttgacgggctacgaactaactgttcgttcgttcgtaacg

SEQ ID NO: 436906 - DNA, 673 bp, Homo sapiens
  misc_feature: GZ8MTXP01BKGQL.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctcgcccgtcaccccgtggagacgcccggcctccatcctcctgcaggtccagtcagacgccctctgacaataagaaatggaattaataacttagtttggattggtatcgtgacaggacggccgagggcctaaccgtccccaacaacctcctagtacttacgttaggtttcggggttactaacggtccgggtaccgttccggggtaccctaagcggttacaggtcggacgtaggtggactaacgaggtcaacgtaagttactttaacactaaaggtaaaactcgaagacgaaggagggtgggaaggtcgtagggaagttacggttagggtttagggtttactaagtcgtacagggttagacgtaacgtacttacgtaacctaaccgttcgtacggtaccggttaccgtttccgggacccgtaacgggtaaacgaaaggttagggaaacttacgtaaacgaacgttacgttggttacgcgtcgaacctacgtattcttcgttcttaacc

SEQ ID NO: 436907 - DNA, 597 bp, Homo sapiens
  misc_feature: GZ8MTXP01AXEBD.13.6.A06.1.454.CMB.2.raw
  modified_base (250)..(250): a, c, t, g, unknown or other
  modified_base (252)..(252): a, c, t, g, unknown or other
  modified_base (274)..(274): a, c, t, g, unknown or other
  modified_base (284)..(284): a, c, t, g, unknown or other
  modified_base (318)..(318): a, c, t, g, unknown or other
  modified_base (328)..(328): a, c, t, g, unknown or other
  modified_base (354)..(354): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctcatctctgcaggtccagtcagacgcctctgcatagaatgatatatattgatgtancngcagagcgaggcacgtccccanactctgactntagttgggttcagtccggccgtccggtcctaagngtcaggtgangtgatcgagcacagtatttacagtanaaatcagcgagagtggagctaggagtagttgggttacgggttatagtgacgtaggtgaacgtagtaccttaccgtaacctaaccgttcgtacggtaccggttaccgttaccggtacccggttaagggaacccgttaaaagggttacggggtaaacttaaccgtaaacggtaaaacccgttaaggtttcggacggtccggtacgaaccgtaaccctagtttacccttggtttaaccgtttcccg

SEQ ID NO: 436908 - DNA, 706 bp, Homo sapiens
  misc_feature: GZ8MTXP01BTKCG.13.6.A06.1.454.CMB.2.raw
  modified_base (366)..(366): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagacgcctcctgcaataagaaatggaattaataacttatttggattggtatctgcagacggccagggccacgtccccaacaacctcctgacttcgttaagtttcgggggttactaacggtccggggtccgtcccggggtaccctaaacgnggtttcaggtcggacaggtggactacgaggcaactagttattttacactaagaaaactctagacgaaggaggtgggaggtcgtagggaagggtagtttggggtttagggtttattacgtgtacgaggttaggacctaacggtccttaacctaacccgtaaaccgttcgttaccgggtcccgggttaaccgttttcccggggccccggtaacggggtaaacccggtaaaaggttacggggtaaacgttaaacgtaaaccggtaaaaacggttaaccgttgggttacgggaaccgtttcggaacccgtaaccttacttcgtttaaccggtttccctttcccg

SEQ ID NO: 436909 - DNA, 669 bp, Homo sapiens
  misc_feature: GZ8MTXP01A3RZL.13.6.A06.1.454.CMB.2.raw
  modified_base (267)..(267): a, c, t, g, unknown or other
  modified_base (487)..(487): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgccggcctccatctcctgcaggtccagtcagacgcctcctgcaataagaaatggaattaataactatttggattggtanctgcgaggacggccgagggaccacgtcccccaactaacctccctagacttcgttaggtttcgggggttactaaggtcccggggtacccttcccgggggttacccctaaagtcgggtttacagggttcggactagggtggaactccgaagggcctaaacgtaagttaactttttaaacgaacttaaggaaaaactcaagactaaggtaagggtgggaaggngttaggaagggttagttggggtttacgggtttaattacgtgtacaggtgacaacgtccttactaaccgtaaccttcgtacggtaccggtaccgtttccggaccgtacgggaaccgtaaaggttgggaattacgtaacgaaacgttacgttggttagcccgtagccactcttcgttcgttctc

SEQ ID NO: 436910 - DNA, 560 bp, Homo sapiens
  misc_feature: GZ8MTXP01EJ13N.13.6.A06.1.454.CMB.2.raw
  modified_base (265)..(265): a, c, t, g, unknown or other
  modified_base (290)..(290): a, c, t, g, unknown or other
  modified_base (397)..(397): a, c, t, g, unknown or other
  modified_base (399)..(399): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctcgccccgtcaccccgtggacgacgcccggcctccatcctcctgcaggtccagtcagacgcctctgacaataagaaatggaatatatattggattganctgcagacgcgaggcacgtcccaanactctgattctagttcgggtactacggtccggccgttccgggtacctaaagtggttcaggtggacaggtgatcgagctatagtactttacataagaaatcagcgagngnggagtgtaggagtagttggttaggttatacgtgactaggtgaacgtaacgtctactaactaaccgtcgtacggtcgtaccgtttccggaccgtagggaactaaagttggaattagaaacgtaaacgcgttggttcgctacgcactattctcgttccttaac

SEQ ID NO: 436911 - DNA, 627 bp, Homo sapiens
  misc_feature: GZ8MTXP01BCEZG.13.6.A06.1.454.CMB.2.raw
  modified_base (245)..(245): a, c, t, g, unknown or other
  modified_base (252)..(254): a, c, t, g, unknown or other
  modified_base (256)..(257): a, c, t, g, unknown or other
  modified_base (259)..(259): a, c, t, g, unknown or other
  modified_base (262)..(262): a, c, t, g, unknown or other
  modified_base (273)..(273): a, c, t, g, unknown or other
  modified_base (278)..(278): a, c, t, g, unknown or other
  modified_base (281)..(281): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcaccccgtggagacgccggcctccatctcctgcaggtccagtcagacgcctctgcatagaatgatatatnttgatgnnngnngngcnggcacgcccanactcnatntagttgggtactacgtcgggcctccgggtcctaagtggtcaggtggcaggtgactcgagcatagtatttacactagaaatcgagcgaaggaggtagggaggtacgtagggtagggttagtttaggggtttaggggtttattacgtagtacgtaggttaggactaacgtaccttaacctaaccgtaaccgttcgttacggtcccggtttacccggtttacccggacccggttaaacggggtaaacccgtaaagggttcgggaaacgttaacgttaaaccgaaaacggttaacgttggttaccggtaactacggaacctacgtattccgttaacgttccgtttaaccg

SEQ ID NO: 436912 - DNA, 763 bp, Homo sapiens
  misc_feature: GZ8MTXP01DGFKG.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgcccggcctccatcctcctgcaggtccagtcagacgcctcctgacaagtaagaaatggaattaataaacttagttggtattggtatctgacgaggacggccgagggccacgtcccccaactactcctagtacttacgttaggtttcggggtttactaaacggttcccgggggtccccgttacccgggggttacccctaaacggtacggttccgtaaggttcgggacgtaggggtacggaacgttacccgaaggtaaccgtaaaccgtaaagggtttaaactttttaaacccgaaaccgttaagggaaaaaacttccgaaagaccgtaagggtaagggttcgggaagggtcgttagggtaagggtaggtttaggggtttaggggtttaacttagtacgtacgtaggtcgaacgtaatcccgttaactaacccgtaaccgttcgttacggtccggttaccgtttacccgggacccggttaagggaaacccgtaaaggttagggaaaccgttaacgtaaacgtaaacgttacgttcggttcggtctacgtccaccgtattccgtcgttcgttaacccg

SEQ ID NO: 436913 - DNA, 703 bp, Homo sapiens
  misc_feature: GZ8MTXP01DJVQ0.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcaccccgtggagacgcccggcctccatctcctgcaggtccagtcagacgcctctgcaagtaagaaatggaattaataaacttagtttggattggtatctgcagacggccgagggccacgtccccaacactcctagactcgttagttcggggttactaacgtccggggtcccgttacccgggggtaccctaaacgtggttcaggttggactaggtcggatcgaagggcaacgtagtaactttacactaagaaaactcgagtacgaggtaggtagggagtcgtaggtaggtagttgggtttagggttattactgtactaggtcgacgtaaacgtccttaactaaaccgtaccttcggttacggtaccggttacccgttttacccggggacccggttaacggggtaaaacccgtaaaaggggttacgggtaaacgttaaacgtaaaaccggtaaaacgttaaccggttgggttccggtaaccgtacggtccctaaaccggtctttacgttccggtttaacctttaaccccg

SEQ ID NO: 436914 - DNA, 529 bp, Homo sapiens
  misc_feature: GZ8MTXP01BIENR.13.6.A06.1.454.CMB.2.raw
  modified_base (259)..(259): a, c, t, g, unknown or other
  modified_base (393)..(393): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatggatataactattggattggtanctgcagaggccagggcacgtccccacaactcctgatctattgggggttctaagtcgggcctccgggggtccctaacgaggttcagtggcagtggatcaggcacagattttacatagaaaatcagcagagtgagntgagtatgttgggttatactgcatgcaagctctacaacctgtacgccggtactttccggccgtgggaacccaaaggttggaagatacgaaaacgttaacgttgttagggctggaacactattcgtcgttcttaacc

SEQ ID NO: 436915 - DNA, 556 bp, Homo sapiens
  misc_feature: GZ8MTXP01DAYHZ.13.6.A06.1.454.CMB.2.raw
  modified_base (223)..(223): a, c, t, g, unknown or other
  modified_base (245)..(245): a, c, t, g, unknown or other
  modified_base (254)..(254): a, c, t, g, unknown or other
  modified_base (256)..(256): a, c, t, g, unknown or other
  modified_base (276)..(276): a, c, t, g, unknown or other
  modified_base (319)..(319): a, c, t, g, unknown or other
  modified_base (364)..(364): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcaccccgtggagacgcccggcctcatctcctgcaggtccagtcagacncctctgcatagaatgatatatnttgatgtancngcagagcaggcacgtcccanactctgatctagttgggtactagtcggcctccgggtacctagngtcagtgcagtgatcgagcatagtatttacatagaaatcagcagngtcggagtgtagagtgttggttacgggttattacgtgtcgtagttacgacgtaaactcctactaacctacgttcgtcggtccgttaccgtttcccgggccgtagggaaccgtaaaggttggaaacgacgtaaacgtaacgttaacggttcggttacgggctcggaacctaacgtacttcttcgttctttccg

SEQ ID NO: 436916 - DNA, 682 bp, Homo sapiens
  misc_feature: GZ8MTXP01BL26Q.13.6.A06.1.454.CMB.2.raw
  modified_base (364)..(364): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagacgcctctgacataagaaatggaattaataacttattggattggtatctgcgaggacggccgagggccacgtccccaacaactcctgacttcgttagttcgggggttactaacggtccgggtccgtcccgggggttaccctaaagnggttcaggtggcgtaggtggatcgaggcaacgtagtatttaacactaagaaatcagacgaggaggtaggagtgtaggtaggtagtttgggtttagggtttaacttagtcgtacgaggttacggactaaacgtccttaacctaacccgtaaccgttcggtaccggtaccggttaacccgtttcccggggtacccggtaacggggtaaaccgaaagggttacgggaacgttaacgttaaaccgaaaacgggttaaccgttgggttacggtaaccgttacggaacctaacccggtcgttaccgttcgtttccgtttaaccg

SEQ ID NO: 436917 - DNA, 290 bp, Homo sapiens
  misc_feature: GZ8MTXP01B3BXV.13.6.A06.1.454.CMB.2.raw
  modified_base (287)..(290): a, c, t, g, unknown or other
tcagtcacgtactacacgaccggtgctcgatttagatctactgacagggactccggggtcccagacagattcagcggcagtgggtcaggcactgatttcacactgaaaatcagcagggtggaggctgaggatgttattgggctctattattgcatgcaagcaacacactggccgtacactttggccaggggaccaagctggagatcaatcgaactgtgctgcaccatctgtcttcatcttcccgcatctgatagtacgtgactgagcgggctggcaaggcgcatagnnnn

SEQ ID NO: 436918 - DNA, 793 bp, Homo sapiens
  misc_feature: GZ8MTXP01BUBDG.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtggaatattgtgatgactcagtctccactctacctgcccgtcaccccgtggagacgcccggcctccatcctcctgcaggtccagtcagacgtccctcctgacaataagaaatggaattaataacttattggattggtatctgcaggacggaccgagggccacgtacccccaactaacctcctagtacttcgttagtttcggggttactaacggtcccgggtcccgttacccggggtaccctaacgtggtttccacggtcggacgtaggtcgacgtacgaacgggcctaaacgtaaacggtttaactttttaaaccgaacgtttaaacgaaaaaacgttcccgaaaggaccgtaaagggtaacgggttacggggaagggtacggttaggggtaaacggggtttagttttacggggttttaagggggttttaaactttaccgtaggtaaccgtaaggggttacggtaaccgtaaacggtacccgttaacccttaacccgtaaaccgttccgttaacgggtccccggtttaaacccgtttcccgggtacccggttaccgggaaaccgtaaagggttacgggtaaacttaacgtaaacgtaacggttacgttcggttacgttcgaccgtaacctacgttaccgttacgttccgttcgttaacccg

SEQ ID NO: 436919 - DNA, 713 bp, Homo sapiens
  misc_feature: GZ8MTXP01CH2JP.13.6.A06.1.454.CMB.2.raw
  modified_base (226)..(226): a, c, t, g, unknown or other
  modified_base (258)..(258): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccgtggagacgcccggcctccatctcctgcaggtccagtcagcgcctcngcaatagaatgatataactattggattggtanctgcgaggacgccgagggccacgtacccccaataaccttcctagtacttcgttaggtttcgggggttacttaacgggtcccggggtccccgttacccgggggttaccctaaacggtacggttccgaaggtcgggacgtaaggttcgggaactaccggaacgggtcctaaaccgtaaggtttaaactttttaaccgaacgttaacgtaaaatccgaagacgtaagggtagggtacggggaggtgttagggtaagggttaggtttacggggtttaggggtttaattaacgtggtactaggtagtaacgtagtacctactacctaaccgttcgtacggtacggttaccgttccgggacccgttaagggaaaccgtaaagggttaggaacgttaacgtaaacgaacggttaacgttggttacgtctcgaaccgtactcttcgttaacgttcgttaaccg

SEQ ID NO: 436920 - DNA, 604 bp, Homo sapiens
  misc_feature: GZ8MTXP01DLV0N.13.6.A06.1.454.CMB.2.raw
  modified_base (263)..(263): a, c, t, g, unknown or other
  modified_base (287)..(287): a, c, t, g, unknown or other
  modified_base (293)..(293): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcaccccgtggagacgccggcctccatctcctgcaggtccagtcagacgcctcctgcaatagaaatggatataactattggattggtanctgcagaggcaggcacgtccccanactctnatctagttgggttactacgtcgggcctccggggtacctaacgtaggttcacggtggcagtgatcgagcacagtatttacgactagaaatcagcaggaggtggaggcgtaggaggtagttgggtttagggtttattacgtgcgtagtcgacgaacgtcctacctaaccgtaaccgttcgttcggtccggttaccgtttccgggacccgtaggggaaaccctaaaggttcgggaaagttaacgtaacgtaaaaccgttaacgttcgggttcggcttacgaacctaccgtattccgttaacgttccgttaaccg

SEQ ID NO: 436921 - DNA, 644 bp, Homo sapiens
  misc_feature: GZ8MTXP01BZDF7.13.6.A06.1.454.CMB.2.raw
  modified_base (268)..(268): a, c, t, g, unknown or other
  modified_base (291)..(291): a, c, t, g, unknown or other
  modified_base (296)..(296): a, c, t, g, unknown or other
  modified_base (338)..(338): a, c, t, g, unknown or other
  modified_base (346)..(346): a, c, t, g, unknown or other
  modified_base (351)..(351): a, c, t, g, unknown or other
  modified_base (362)..(362): a, c, t, g, unknown or other
  modified_base (389)..(389): a, c, t, g, unknown or other
  modified_base (393)..(393): a, c, t, g, unknown or other
  modified_base (400)..(400): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgccggcctcatctcctgcaggtccagtcagacgcctctgcaataagaaatggaattataacttagtttggattggtatcngcagcggcagggcacgtccccanactcngtatctagttggggtactaagtcgggcctccgggaccctagnggtcaggnggacngtggactacgngtcatagtatttacatagaaatcgagnaggngtcgagntaggaggtagttcgggttaggttactaagtgactagtcgacgtaacgtcgtacctaaccgtaaccttcgtacgggtacccgttaccgggtttaccccgggacccggttaaggggaaacccttaaaaggggttggggaaaaccgttaacttaaaccgggaaaaacccgttacggttgggttaaccgggtccgtaccgaacccgtaaaccttactttacccggttcgttttcccgttttaaccccg

SEQ ID NO: 436922 - DNA, 688 bp, Homo sapiens
  misc_feature: GZ8MTXP01EAOVU.13.6.A06.1.454.CMB.2.raw
  modified_base (208)..(208): a, c, t, g, unknown or other
tcagtcacgtactacacgaccggtgctcgatttagatctactgacaggggaggactcctcagttcaccttctcacaatgaggctccctgctcagctccgtggggctgctaatgctctgggtcctccggatcagtgggaatattgtgatgactcagtctccactctacctgccccgtcaccccgtggacgaggcccggcctcatctccngcagtccagtccagacgcctctgacataagaaatgaattaataacttgttggattggtatctgcagacggccgaggccaacgtccccaatactccgtagtacttagttaaggtttcgggggtttactaaacgggttcccggggtacccgtttacccgggggtacccttaaaggtaggttccgaacgggttcggaacgtaggttcggaactaaccggaagggtccctaaatacggtttaaacttttaccgaaattaaacgggaaaaacttcgaagtacgaaggtaaggggtagggaggtacgtaaggggtaacggttagtttaggggtttaccgggtttaatacgttagtactagttagacgtaaacgtctaccaacgtactcgacgtcgtacgttccggccgtagggaaactagggttagacttaaacgtacgaaagttacgttgacggctgaacctacacgttcgtcttccgttaaccg

SEQ ID NO: 436923 - DNA, 646 bp, Homo sapiens
  misc_feature: GZ8MTXP01DVNSB.13.6.A06.1.454.CMB.2.raw
  modified_base (265)..(265): a, c, t, g, unknown or other
  modified_base (343)..(343): a, c, t, g, unknown or other
  modified_base (581)..(581): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtggaatattgtgatgactcagtctccactctacctgccccgtcacccctggagacgccggcctcatctcctgcaggtccagtcagacgcctcctgcataagaaatggaattaataaacttattggattaggtnactgcagagccgaggcagtccccaacgactcctgatctagttgggttactacgtcgggccgtacgggtaccctaacgngttacgaagtcggactaggtggtatacgaagggcctaaagagtaaactttttaacacctaataaaagtcaagtacgaagtaggtagggagtgtaggtaaggtagttagggtttagggttttaaacgttacgtttagaccgtaattacggtacgtaaagtccctacttaaacctacccgtagtacggtccggtaaacgtttccgggcccggtaacgggtaaccggtaaagttggggaanaacgtaaacgtaaaccgaaacgttcggttagcgtacgtctaacccattccttgttctttaacccg

SEQ ID NO: 436924 - DNA, 505 bp, Homo sapiens
  misc_feature: GZ8MTXP02IF9S6.13.6.A06.1.454.CMB.2.raw
  modified_base (285)..(285): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatggaatataactattggattggtatctgcagaggccagggcagtccccanaactcctgatctagttggggttctaagtccgggcctccggggtccctaagaggttcagtgcagtggatcgaggcacagtattttacactagaaaatcagcagagtggagctagaggatggttgggttatacgtgcatgcaagctactacaactctagcgtacttcggccgtggaccaaggtgagatacaacgaactgtagcgtcgacacatctgtcttac

SEQ ID NO: 436925 - DNA, 494 bp, Homo sapiens
  misc_feature: GZ8MTXP02GVCA9.13.6.A06.1.454.CMB.2.raw
  modified_base (408)..(408): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctattggggttctaatcgggcctccggggtcctaacaggttcagtggcagtggatcaggcacagtatttacactagaaaatcagcagagtggagctgagatggttgggttatacngcatgcaagctctacactctgcgtacttcggcctgggaccaaagtggacgatacaacgaactgtaggctgcaccgatctgttctac

SEQ ID NO: 436926 - DNA, 568 bp, Homo sapiens
  misc_feature: GZ8MTXP02G9WQE.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggatgatctgcagaggccagggcacgtccccacaactcctgatctagttggggtactaagtcgggcctccggggtaccctaagaggttcaggtggcagtggatcgaggcacagtatttacactagaaaatcagcagagtgggagcgtagaggtagttggtttaggggttattacgtggactagtaggactaaagcttactaacctaaccctgtcggtacggtaccgtttccggacccgtacgggtaaaccgaaaggtaggaagaactaaccgaaaacgtaacgtggtacggctcggacctacctagtctcgttctttaccg

SEQ ID NO: 436927 - DNA, 585 bp, Homo sapiens
  misc_feature: GZ8MTXP02H0VJ9.13.6.A06.1.454.CMB.2.raw
tcagtcacgtactacacgaccggtgctcgatttagatctactgacagggaggactcctcagttcaccttctcacaatgaggctccctgctcagctcctgggctgctaatgctctgggtctccggatccagtgggaatattgtgatgactcagtctccactctacctgcccgtcacccctggagagccggcctccatctcctgcaggtccagtcagagcctcctgcatagaaatggatataactattgattgtatctgcagaggccagggcagtccccacaactcctgatctagttggggttctaagtcgggcctccggggtaccctaacgaggttcagtggcagtggatcgaggcacagtattttacactagaaaatcagcagagtggaggctagaggtagttggttaggggtttattacgttgactagtgacgaagtctactacaaacccgtcgttacggccggttaaccgtttccgggaccccgttacggggaaacccgtaaaagggttacgggaaagtaacgtaacgaaaacgaacgttaggtcggaacgttcggaccacctagttaccttgtttaccttcg

SEQ ID NO: 436928 - DNA, 494 bp, Homo sapiens
  misc_feature: GZ8MTXP02JC23J.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctattggggttctaatcgggctccggggtcctacaggttcagtgcagtggatcaggcacagattttacactgaaaatcagcagagtggaggctgaggatggttggggttatacgtgcatgcaagctcacaacctctgcggacttcggccctgggaccaaaaggtggagatacaacgaactgtgctgcaccatcctgctttc

SEQ ID NO: 436929 - DNA, 534 bp, Homo sapiens
  misc_feature: GZ8MTXP02HQB77.13.6.A06.1.454.CMB.2.raw
  modified_base (329)..(329): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctctgcatagaatgatataactattggattgtatctgcagaggccagggcagtccccacaactcctgatctagttggggttctaagtcgggcctccggggtcctaacnggttcagtggcagtggatcaggcacagtattttacactagaaaatcagcagggtgaggctgaggattgttagtgggctcgtatttattgctatgacaagcaacacacgtcggaccgtacgtacgtttcgggccgaagggggaccaaaggtcgtaggacgattacgaaacgtaaccgaaacgtggtcggactcggcctaacctacg

SEQ ID NO: 436930 - DNA, 507 bp, Homo sapiens
  misc_feature: GZ8MTXP02GIS5A.13.6.A06.1.454.CMB.2.raw
  modified_base (333)..(333): a, c, t, g, unknown or other
  modified_base (391)..(391): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctagttggggttctaagtcgggcctccggggtccctaagnggttcagtggcagtggatcaggcacagtatttacactagaaaatcagcagagtggagntgaggtatggttgggttattactgcatgcaagctctacaacctctgcggtactttcggccgtaggaccaaagtggagatacgaaacgaactgtaggctcgacaccatctcgtcttc

SEQ ID NO: 436931 - DNA, 640 bp, Homo sapiens
  misc_feature: GZ8MTXP02JUC0B.13.6.A06.1.454.CMB.2.raw
  modified_base (284)..(284): a, c, t, g, unknown or other
  modified_base (334)..(334): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccanaactcctgatctagttggggttctaagtcgggcctccggggtccctaagnggttcagtggcagtggatcgaggcacagtactttacactagaaaatcagcagagtggaggcgtaggaggtagttgggtttaggggtttattacgtggtctaagttcgacgtaagtccttacctaacctaacccgttcgtcgggtaccgggttaaccgttttcccggggaccccgttaacgggggaaacccgtaaaaggggttacgggaaacggtaaacgttaaacccgaaaaacggtaaaccgttaggtacggggaaccgttacggacctaacccgtaatttcccgttacggtttacctttacccg

SEQ ID NO: 436932 - DNA, 515 bp, Homo sapiens
  misc_feature: GZ8MTXP02JSCFF.13.6.A06.1.454.CMB.2.raw
  modified_base (282)..(282): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggattggtatctgcagaggccagggcagtccccanaactcctgatctattggggttctaagtcgggcctccggggtcctaacaggttcagtggcagtggatcaggcacagattttacactagaaaatcagcagagtggaggctggaggagtggttggggttattacgtgacatgcaagctactacaacctctagcggactttcggccctaggggtaccaaaaggtggaacgagtacaaaacgaacgtgtggctgcacatctcgtcttc

SEQ ID NO: 436933 - DNA, 572 bp, Homo sapiens
  misc_feature: GZ8MTXP02JETUU.13.6.A06.1.454.CMB.2.raw
  modified_base (278)..(278): a, c, t, g, unknown or other
  modified_base (324)..(324): a, c, t, g, unknown or other
  modified_base (385)..(385): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaatgatataactattggattggatctgcagagcaggcagtccccanactcctgatctagttgggtctaagtcgggcctccggggtcctaagnggttcagtggcagtggatcgaggcactagtatttacactagaaaatcagcagagtggaggngtagaggtattggtttaggggtttattacgtgactagtgacaagtctactacgaaccttcgtcggtaccggtaccgtttccgggcccgtacggggtaacccgaaaaggtcggaaagtaactaacgaaaaccgtaacgttaggtacgggcttacggactacccgtaattccgtttacgtcctttaccg

SEQ ID NO: 436934 - DNA, 499 bp, Homo sapiens
  misc_feature: GZ8MTXP02JVZY0.13.6.A06.1.454.CMB.2.raw
  modified_base (284)..(284): a, c, t, g, unknown or other
  modified_base (331)..(331): a, c, t, g, unknown or other
  modified_base (430)..(430): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccanaactcctgatctattggggttctaatcgggcctccggggtccctaanggttcagtggcagtggatcaggcacagatttacactgaaaatcagcagagtggaggctgaggatgttgggtttatactgcatgcaagctctacaacctntagcgactttcggcctggaccaaagtggacgatacaaacgactgtaggctggacaccatcctgtcttac

SEQ ID NO: 436935 - DNA, 515 bp, Homo sapiens
  misc_feature: GZ8MTXP02IOXEI.13.6.A06.1.454.CMB.2.raw
  modified_base (330)..(330): a, c, t, g, unknown or other
  modified_base (376)..(376): a, c, t, g, unknown or other
  modified_base (386)..(386): a, c, t, g, unknown or other
  modified_base (393)..(393): a, c, t, g, unknown or other
  modified_base (432)..(432): a, c, t, g, unknown or other
  modified_base (508)..(508): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctattggggttctaatcgggcctccggggtccctaanaggttcagtgcagtggatcaggcacagatttacactgaaaatcagnagagtggagntagaggntggttggggttatactgcatgcaagtctactacaacctntacgcggtactttcgggcccttaggggaccaaaggtaggagtaatacaaaacgactgtaggaactgacaccatccngtcttac

SEQ ID NO: 436936 - DNA, 545 bp, Homo sapiens
  misc_feature: GZ8MTXP02JSPZQ.13.6.A06.1.454.CMB.2.raw
  modified_base (302)..(302): a, c, t, g, unknown or other
  modified_base (416)..(416): a, c, t, g, unknown or other
tcagtcacgtactacacgaccggtgctcgatttagatctactgacaggggaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcagaggccaggccaatctccaaggcgacctaatttataaggtntctgacgagggactccggggtccagacagattcgagcggcaggtggggtcaggcacgtgatttcacactagaaaatcagcgaggggtgaggctgaggtatgttagttgggcttntattattgcagtgacaagcaaacactaacgtcggacccttactacgtttcgggaccgtagggggaacccaaaggccgtagggacgtacgtacaaacgttcgaaacgtggtcggactcggaccacctacg

SEQ ID NO: 436937 - DNA, 523 bp, Homo sapiens
  misc_feature: GZ8MTXP02HQOUU.13.6.A06.1.454.CMB.2.raw
  modified_base (282)..(282): a, c, t, g, unknown or other
  modified_base (333)..(333): a, c, t, g, unknown or other
  modified_base (392)..(392): a, c, t, g, unknown or other
  modified_base (501)..(501): a, c, t, g, unknown or other
  modified_base (517)..(517): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggattggtatctgcagaggccagggcagtccccanaactcctgatctagttggggttctaagtcggggcctccggggtccctaagnggttcagtggcagtggatcagggcacagtattttacacttagaaaatcagcagagtggngctgaggtattggttaggggtttattacgtgtacaattgacaagctactacaacctgtagcgtactttcggccctagggaaccaaaggtcggagaatacaaacgactgnggaactgacacatctnttctac

SEQ ID NO: 436938 - DNA, 498 bp, Homo sapiens
  misc_feature: GZ8MTXP02ISP8W.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctattggggttctaagtcgggcctccggggtcctaacaggttcagtggcagtggatcaggcacagattttacactagaaaatcagcagagtggagctgaggatggttggggttatacgtgcatgcaagctactacaacctctgcggactttcggcctgggaccaaagtggagatacaacgaactgtaggctgcacatctgtcttc

SEQ ID NO: 436939 - DNA, 520 bp, Homo sapiens
  misc_feature: GZ8MTXP02FQJP8.13.6.A06.1.454.CMB.2.raw
  modified_base (283)..(283): a, c, t, g, unknown or other
  modified_base (332)..(332): a, c, t, g, unknown or other
  modified_base (494)..(494): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagagccagggcagtccccanaactcctgatctagttggggttctaagtcgggcctccggggtccctaanaggttcagtggcagtggatcgaggcacagtattttacactagaaaatcagcaagagtggaggcgtgaggtatggttggggttattacgtgcatgcaagctactacaacctctacgcggactttcggccctgggtaccaaaggtggagatacgaaacgtaacngtaggcgtagcaccatctgtcttacg

SEQ ID NO: 436940 - DNA, 510 bp, Homo sapiens
  misc_feature: GZ8MTXP02I0SBG.13.6.A06.1.454.CMB.2.raw
  modified_base (391)..(391): a, c, t, g, unknown or other
  modified_base (420)..(420): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcacgtccccacaactcctgatctagttggggtctaagtcgggcctccggggtaccctacgaggttcagtgcagtggatcaggcacagtatttacactagaaaatcagcagagtggagntgaggatggttagggtttatacgtgacangtcaagctacacactctgcgtacttcgcccgtggaccgaaaggtcggaagatacgaaacgacgtgtaggcgtagacacatctcgtcttac

SEQ ID NO: 436941 - DNA, 494 bp, Homo sapiens
  misc_feature: GZ8MTXP02HYZWD.13.6.A06.1.454.CMB.2.raw
  modified_base (409)..(409): a, c, t, g, unknown or other
  modified_base (411)..(411): a, c, t, g, unknown or other
  modified_base (413)..(413): a, c, t, g, unknown or other
  modified_base (415)..(415): a, c, t, g, unknown or other
  modified_base (461)..(461): a, c, t, g, unknown or other
  modified_base (475)..(475): a, c, t, g, unknown or other
  modified_base (477)..(477): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccctggagagccggcctccatctcctgcaggtccagtcagagcctctgcatagaaatgatataactattggatggtatctgcagaggccagggcagtccccacaactcctgatctattggggttctaatcgggcctccggggtccctaaacaggttcagtggcagtggatcaggcacagattttacactgaaaatcagcagagtgaggcgtgagagtgtgggttagttatgtnangnanactactacactctgtcgtacgttcgtccgtacggacgaagagaganacaacgaacgtagngngcgacacactctctctc

SEQ ID NO: 436942 - DNA, 535 bp, Homo sapiens
  misc_feature: GZ8MTXP02J37VB.13.6.A06.1.454.CMB.2.raw
  modified_base (319)..(319): a, c, t, g, unknown or other
  modified_base (344)..(344): a, c, t, g, unknown or other
  modified_base (416)..(416): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccctggagagccggcctccatctcctgcaggtccagtcagagcctctgcatagaatgatataactattggattggatctgcagagcaggcacgtcccacactctgatctagttgggttctagtcggcctccgggtacctaagnggttcagtggcagtggatcgagcanagtatttacactagaaaatcagacgagagtggaggcgtggaggtagttaggttagggtttagttacgttganagtagacgacgtactactactacgtacgtcgtcggtacgttaccgtaccgtacggtaacgtaacgagacgtacgtaacgaacgaacgtacgtacgtcgtacgacactactactcgtctc

SEQ ID NO: 436943 - DNA, 507 bp, Homo sapiens
  misc_feature: GZ8MTXP02GT9G4.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtcctaacaggttcagtggcagtggatcaggcacagatttacactagaaaatcagcagagtggaggctgaggtatgttaggggtttattacgtgcatgacaagctactacaacctctgcggactttcggccgtggaaccgaaagtggagatacgaaacgaactgtagcgtgcaccatctgtcttc

SEQ ID NO: 436944 - DNA, 634 bp, Homo sapiens
  misc_feature: GZ8MTXP02H10XS.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatggatataactatttggattggtatctgcagaggccagggcacgtccccacaactcctgatctattggggttctaagtccgggccgtccggggtaccctaacgaggttcagtggcagtggatcgaggcacagtacttttacaacttagaaaatcagacaaggagtggagggcgttaggagggtagttagggtttagggggtttattacgttggactagttaggacgtaaacggtcttactaaccgtaaccctcgttacggccggttaaccgtttccggggtaccccgttacggggaacccgtaaaaggttacgggaagtaaacgttaaccgaaaaccgtaaccgttaggtacgggtcgttacggacctacccgtatttccggttcgtttacctttaccg

SEQ ID NO: 436945 - DNA, 528 bp, Homo sapiens
  misc_feature: GZ8MTXP02GTPMX.13.6.A06.1.454.CMB.2.raw
  modified_base (332)..(332): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctaactgcccgtcacccctggagagccggcctccatctcctgcaggtccagtcagagcctcctgcatagaaatggatataactattggattggtatctgcagaggccagggcagtccccacaactcctgatctagttggggttctaagtcgggcctccggggtcctaacnggttcagtggcagtggatcgagcacagtattttacactagaaaatcagcagagtggagctagaggtattggttggggtttattacgtgctatgacgaagtctactaaccaacctctggcggtacttcgggcccgttagggaaccctaaaggtggaacgactacgaaacgaactgtaggctgacacatctcgtcttc

SEQ ID NO: 436946 - DNA, 532 bp, Homo sapiens
  misc_feature: GZ8MTXP02HBHZ4.13.6.A06.1.454.CMB.2.raw
  modified_base (429)..(429): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctagttggggttctaagtcgggcctccggggtccctaagaggttcagtgcagtggatcaggcacagtattttacactagaaaatcagcagagtggagctagaggattggttaggggtttattacgtggctatganaagtctactaacaacctgtcggcggtactttccggcccttaggggaaccaaaggtggacagtaacaaacgaactggtaggctcgacaccatcgtcgttacttc

SEQ ID NO: 436947 - DNA, 493 bp, Homo sapiens
  misc_feature: GZ8MTXP02IY6LG.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggattggtatctgcagaggccagggcagtccccacaactcctgatctattggggtctaagtcgggctccggggtcctaacgaggttcagtggcagtggatcaggcacagatttacacttagaaaatcagcagagtggagctgaggtatgttggggttatacgtgcatgcaagctactacaactctgcgtacttcgcctggaccaagtggacgatacaacgaactgtagcgtgcacgatctgtcttc

SEQ ID NO: 436948 - DNA, 541 bp, Homo sapiens
  misc_feature: GZ8MTXP02INPVV.13.6.A06.1.454.CMB.2.raw
  modified_base (333)..(333): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggccagtccccacaactcctgatctagttggggttctaagtcgggcctccggggtcctacnggttcagtgcagtgatcaggcacagtattttacactagaaaatcagcaggagtggaggctagaggtattggtttggggtttattacgtgctatgacaagtctacctacaaccttcgtacggtcggtacgtttccggccgtacgggaaccgaaagtaggacgtaactacgaaacgtaactgtggcgtcgacacgtatcttcgtctttac

SEQ ID NO: 436949 - DNA, 606 bp, Homo sapiens
  misc_feature: GZ8MTXP02FPQXY.13.6.A06.1.454.CMB.2.raw
  modified_base (338)..(338): a, c, t, g, unknown or other
  modified_base (398)..(398): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcacgtccccacaactcctgatctagttggggttactaagtccgggccgtccggggtaccctaagnggttcaggtggcagtggatcgaggcacagtatttacatagaaaatcagcagagtggaggntaggaggtagttgggtttggggtttaattacgtggcaagttcgacgtaaacgtccttacctaaccgtaaacccttcgtcgggtaccggttaccgttttccgggccccgttaacggggaaaacccgaaaagggttcggaaagtaacgtaacgtaaaaccggtaaacgtggtacgggctacggacctaccctattctacgttactttccg

SEQ ID NO: 436950 - DNA, 534 bp, Homo sapiens
  misc_feature: GZ8MTXP02F5RYW.13.6.A06.1.454.CMB.2.raw
  modified_base (285)..(285): a, c, t, g, unknown or other
  modified_base (386)..(386): a, c, t, g, unknown or other
  modified_base (397)..(397): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcacgtccccanactcctgatctagttggggttactaagtcggccgttccggggtaccctaagaggttcaggtggcagtggatcgaggcacagtatttacactagaaaatcancagagtggagntgagtatggttgggttatcgtgcatgacaagtctactaaccaacctcgtggccggtacgtttccgggcccgtagggaacctaaaggtggagaatacgaaaacgtaacgtggtacgctcgacacctatctcgtcttac

SEQ ID NO: 436951 - DNA, 517 bp, Homo sapiens
  misc_feature: GZ8MTXP02GGL7W.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaatgatatactattgatggtatctgcagaggccagggcagtccccacaactcctgatctagttggggttctaagtccgggccgtccggggtcctaacgaggttcagtggcagtggatcaggcacagtatttacactagaaaatcagcaggagtaggaggctagaggtagttggttggggtttattacgtgctagtgacaagctactaccgtaactctgcggtacttcggccgtagggacctaagtggagatacaaacgactgtagctgcacctatctcgttcttac

SEQ ID NO: 436952 - DNA, 607 bp, Homo sapiens
  misc_feature: GZ8MTXP02F030O.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcacgtccccacaactcctgatctagttggggttctaagtccggggccgtcccggggtaccctaacgtacggttcagtggcaggtggatcgagcacagtatttacatagaaatcagcagagtggaggcgtagaggtagttgggtttaggggtttattacgtggctagtgacaagtcctactaacctaaccttcgtacggtaccggtaccgtttaccggaccccggttacggggaaacctaaaagggttaggaacggtaaacgttaaccgaaaaaccggttaaaccgtgggttacggcgtacggaccaacccgtattcgttacgtttcctttaccg

SEQ ID NO: 436953 - DNA, 502 bp, Homo sapiens
  misc_feature: GZ8MTXP02GHZ2V.13.6.A06.1.454.CMB.2.raw
  modified_base (414)..(414): a, c, t, g, unknown or other
  modified_base (430)..(430): a, c, t, g, unknown or other
  modified_base (476)..(476): a, c, t, g, unknown or other
  modified_base (479)..(479): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaatgatataatattggatgtatctgcagagccagggcagtccccacaactcctgatctagttggggttctaagtcgggccttccggggtacctaaaggtcagtggcagtggatcaggcacagtattttacactagaaaatcagcagagtggagctgaggatggttaggggttatagtgcatggnaagctactacaacctntgcggtacttcggcctaggggacaaagtggagtacacaaacgtacncgngcgtgcaccagtctgtctactac

SEQ ID NO: 436954 - DNA, 510 bp, Homo sapiens
  misc_feature: GZ8MTXP02HR8FN.13.6.A06.1.454.CMB.2.raw
  modified_base (334)..(334): a, c, t, g, unknown or other
  modified_base (478)..(478): a, c, t, g, unknown or other
  modified_base (493)..(493): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatggatataactatttggattggtatctgcagaggccagggcagtccccacaactcctgatctattggggttctaagtcgggcctccggggtcctaacgnggttcagtggcagtggatcgaggcacagtattttacactagaaaatcagcagagtggaggctggaggtattggttggggtttattacgtgcagtgcaagctactacaacctctgcggtacttcggccgtggaccgaaagtgganatacaaacgactagngctgcacatctgtcttc

SEQ ID NO: 436955 - DNA, 513 bp, Homo sapiens
  misc_feature: GZ8MTXP02F8FEW.13.6.A06.1.454.CMB.2.raw
  modified_base (333)..(333): a, c, t, g, unknown or other
  modified_base (423)..(423): a, c, t, g, unknown or other
  modified_base (430)..(430): a, c, t, g, unknown or other
  modified_base (502)..(502): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaagtcgggccttccggggtccctaanggttcagtggcagtggatcagggcacagtattttacactagaaaatcagcaggagtggaggctgaggtatggttgggttatactgcatgnaagctanaccaactcgtgcggacttcggcctagggaaccaaaggtggacgaatacgaaacgaacgtgtggcgtgcaacntctgtctttac

SEQ ID NO: 436956 - DNA, 613 bp, Homo sapiens
  misc_feature: GZ8MTXP02IBT66.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggatggtatctgcagaggccagggcacgtccccacaactcctgatctagtttggggttactaagtccgggcctccggggtaccctaagaggttcacggtggcagtggatcgaggcacagtatttacactagaaaatcagcgagagtaggaggcgtaggaggtagttggttagggggtttattaacgtgtactagttggactaagtacctacttaacgtaaacccttcgtacggtccgggttaaccgtttccgggaccccgtaacggggtaaaccgaaaagggttacgggaaagtaacgtaacgaaaaacgtaaccgttggtacggtaaccgtcgaccgtaaccacgtttcctgtttacctttaccg

SEQ ID NO: 436957 - DNA, 517 bp, Homo sapiens
  misc_feature: GZ8MTXP02IV94Y.13.6.A06.1.454.CMB.2.raw
  modified_base (251)..(251): a, c, t, g, unknown or other
  modified_base (256)..(256): a, c, t, g, unknown or other
  modified_base (271)..(271): a, c, t, g, unknown or other
  modified_base (319)..(319): a, c, t, g, unknown or other
  modified_base (377)..(377): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccgtggagacgccggcctccatctcctgcaggtccagtcagagcctctgcatagaatgatatatattgatgatngcagngcaggcacgtcccanactctgatctagttgggttctacgtcggccgtccggggtacctaacgnggttcagtggacaggtgatcgagcactagtatttacatagaaatcagcagagtggagngtagaggtagttggtttagggttattagtagctagtcgagaagtctactaactacctcgtcgtcgtcgttcgccgtagggaacaggtagacgactaacgaaacgtacgtcgtagcgtcgacactatctacgtacttaccg

SEQ ID NO: 436958 - DNA, 491 bp, Homo sapiens
  misc_feature: GZ8MTXP02HPQMI.13.6.A06.1.454.CMB.2.raw
  modified_base (329)..(329): a, c, t, g, unknown or other
  modified_base (473)..(473): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctattggggttctaagtcgggcctcggggtcctaanggttcagtgcagtggatcaggcacagatttacactagaaaatcagcagagtggagctgaggatgttgggttatacgtgctatgcaagctactacaactctgcgactttcgcctggaccaaagtgagatacaaacgaactgtagntcgacaccatctgtcttc

SEQ ID NO: 436959 - DNA, 595 bp, Homo sapiens
  misc_feature: GZ8MTXP02G2VOU.13.6.A06.1.454.CMB.2.raw
  modified_base (332)..(332): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccctggagagccggcctccatcctcctgcaggtccagtcagagcctctgcatagaatggatataactattggattggtatctgcagaggccgagggcacgtccccacaactcctgatctagttggggttctaagtcggcctccggggtacctaagnggttcagtggcagtggatcgaggcacagtatttacactagaaaatcagcgaagtagtaggaggtcgtaggagggtagttgggtttacggggtttattaacgtgtactaagttcggaataacgtcctacctaaacctaccgtcgtcggtaccggttaccgttccgggtacccgtaacgggtaaaccgtaaaggtacggaacgtaacgtaaacgaaaacgtaacgtggtacgaacgtacgacctactacgtcgttacgtttactc

SEQ ID NO: 436960 - DNA, 604 bp, Homo sapiens
  misc_feature: GZ8MTXP02JVGTP.13.6.A06.1.454.CMB.2.raw
  modified_base (283)..(283): a, c, t, g, unknown or other
  modified_base (331)..(331): a, c, t, g, unknown or other
  modified_base (357)..(357): a, c, t, g, unknown or other
  modified_base (391)..(391): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccanaactcctgatctagttggggtctaagtcgggcctccggggtcctaacnggttcagtggcagtggatcgaggcanagtattttacactagaaaatcagcagagtgaggntgaggtatggttacggggtttattacgtaggctagtgacgaaggtccttactaaccaaacccgttcgtacggtccggtaccgtttccgggtccccgtaacggggtaacccgtaaaaaggttgggaagaaacgttaccgaaaaaccggtaaccgttggttaacggggccttacggaacccacccgtaagttacctttcgttccgttttaacccg

SEQ ID NO: 436961 - DNA, 513 bp, Homo sapiens
  misc_feature: GZ8MTXP02F6E7F.13.6.A06.1.454.CMB.2.raw
  modified_base (283)..(283): a, c, t, g, unknown or other
  modified_base (492)..(492): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccanactcctgatctattggggttctaagtcgggcctccggggtcctaacgaggttcagtggcagtggatcgaggcacagtatttgcactagaaaatcagcagagtggagctgaggagtggttaggggtttattacgttgcatgcaagctactacaacctgtagcggtacttcggcccgtgggaccaaagtggaagactacgaaaacgactgnggctcgacactactctgtttc

SEQ ID NO: 436962 - DNA, 614 bp, Homo sapiens
  misc_feature: GZ8MTXP02G3AX1.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaatggatataactattggattggtatctgcagaggccagggcagtccccacaactcctgattctagttggggttctaagtcgggcctccggggtcctaacgaggttcaggtgcagtggatcgaggcacagtatttacactagaaaactcaagcaaggagtagggaggctaggaggtagttgggtttaggggtttattacgtagtctagtgactaagtcttactaaccctaaccgttcgtcggtaccggttaccgtttccgggaccccgttaacggggtaaacccgtaaaagggttcgggaaacgtaacgttaaccgaaaaccggtaaacgtaggttacgggccttacggaccgtaccctaagttccttaccgtttctttaccg

SEQ ID NO: 436963 - DNA, 620 bp, Homo sapiens
  misc_feature: GZ8MTXP02HHB4I.13.6.A06.1.454.CMB.2.raw
  modified_base (288)..(288): a, c, t, g, unknown or other
  modified_base (339)..(339): a, c, t, g, unknown or other
tcagtcacgtactacacgaccggtgctcgatttagatctactgacaggggaggactcctcagttcaccttctcacaatgaggctccctgctcagctccgtggggctgctaatgctctgggtctccggatccagtgggaatattgtgatgactcagtctccactctacctcgcccgtcacccgtggagacgcccggcctccatctcctgcaggtcagtcagacgcctcctgacataagaaatgaatataatgttggattggtatctgcaggaggcaggcacgtccccanactctgatcgtagttcgggtactacgtccgggtccgtccgggtacctaagnggttcaggtgcagtggatcgaggcacgtagttactttacactagaaaatcgagacgaggaggtgggacggtgtagggaaggttagttcggggtttaagggtttatacgttgacgtagtcgaacgtaacgtcccttaactaaccgtaaccgttcgtcggtaccggttaccggttttccgggacccggttaagggaaaccgtaaagggtcggaaacggtactaaaccgaaagtaccgtagtacggccttaggcctaacgttacgttccgttacgttccttacg

SEQ ID NO: 436964 - DNA, 541 bp, Homo sapiens
  misc_feature: GZ8MTXP02H0HRU.13.6.A06.1.454.CMB.2.raw
  modified_base (338)..(338): a, c, t, g, unknown or other
  modified_base (389)..(389): a, c, t, g, unknown or other
  modified_base (400)..(400): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgccggcctccatctcctgcaggtccagtcagagcctcctgcatagaaatggatataactattggattggtatctgcagaggccagggcacgtccccacaactcctgatctagttggggttctaagtcgggcctcccggggtacctaacgnggttcagtggcaggtggatcgaggcacagtattttacactagaaaatcagnagagtggaggntaggaggtagttggtttaggggtttatacgtgacatgacaagcgtactacaactctggcggtactttccggccgtacgggaaccaaaggtggacgactaacgaaacgaacgtgtaggcgtcgacactatcctgtccttacg

SEQ ID NO: 436965 - DNA, 609 bp, Homo sapiens
  misc_feature: GZ8MTXP02JDBEP.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcacgtccccacaactcctgatctagttcggggttactaagtccgggcctccggggtaccctaacgaggttcaggtgcagtggatcgagcacagtatttacactagaaaatcagcagagtggagcgtagaggtagttgggtttaggggtttaattacgtagtactagtagacgtaaacgtcctacctaaccgtaaacccttcgtacggtccggttaccgtttccgggccccgtacggggtaaccctaaaagggtcggaaacgtaaacgtaaccgtaaaacggtaaccgttaggtacgggtctacggaccgacctacgttcttacgtttcctttaccg

SEQ ID NO: 436966 - DNA, 528 bp, Homo sapiens
  misc_feature: GZ8MTXP02IMMWL.13.6.A06.1.454.CMB.2.raw
  modified_base (245)..(245): a, c, t, g, unknown or other
  modified_base (249)..(249): a, c, t, g, unknown or other
  modified_base (255)..(255): a, c, t, g, unknown or other
  modified_base (260)..(260): a, c, t, g, unknown or other
  modified_base (282)..(282): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagagccggcctccatctcctgcaggtccagtcagagcctctgcatagaaatgatataactnttgntgatcngcagngcaggcagtccccacaactccngatctagttgggtctaagtcgggcctccggggtcctaagaggttcagtggcaggtggatcgaggcaacgtagtaactttacactagaaaatcagcaagagtaggaggcgtagagggtattcgggtttaggggtttattacgtggactagtgacaagtctactaacacctgtgcggtacttccggacgtcggaacaagtggaacacgtacgaaacgacgtgtacggctgaccacgatctcgttcttc

SEQ ID NO: 436967 - DNA, 607 bp, Homo sapiens
  misc_feature: GZ8MTXP02HO8AJ.13.6.A06.1.454.CMB.2.raw
  modified_base (258)..(258): a, c, t, g, unknown or other
  modified_base (279)..(279): a, c, t, g, unknown or other
  modified_base (395)..(395): a, c, t, g, unknown or other
tcagtcacgtactacacgaccggtgctcgatttagatctactgacaggggaagactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctctgcatagaaatggatataatattggattgtatcngcagagcagggcagtccccanaactcctgatctagttggggttactaagtccgggcctccggggtaccctaacgaggttcagtggctagtggatcgaggcactagtatttacatagaaaatcagcagagtaggaggngtaggaggtagttgggtttagggggtttattacgtgtacgtagtaggtactaaggtcctacctaaacctaaaccttcgtggtaccgggttacgttttccggggaccccgttagggggaaaccctaaaaggggttgggaaacgtaaacgttaaccgaaaacggtacgttagggttcggaactacggactacctagttcttacgttctttaccg

SEQ ID NO: 436968 - DNA, 548 bp, Homo sapiens
  misc_feature: GZ8MTXP02GO39Y.13.6.A06.1.454.CMB.2.raw
  modified_base (339)..(339): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcacgtccccacaactcctgatctagttggggttactaagtccgggcctccggggtccctaacgnggttcagtggcagtggatcgagcacagtactttacactagaaaatcagcagagtggaggctggaggtagttgggtttaggggttattacgtgcagtgacagctactacaactgtcggcgtacgtttccggccgtaggggaacctaaaggtggacgaacgtaacgaaacgaacgtggtacggctacggacaccgtatctacgttcttacc

SEQ ID NO: 436969 - DNA, 529 bp, Homo sapiens
  misc_feature: GZ8MTXP02JZM9R.13.6.A06.1.454.CMB.2.raw
  modified_base (283)..(283): a, c, t, g, unknown or other
  modified_base (391)..(391): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccanactctgatctagttggggttctaagtcgggcctccggggtaccctaacgaggttcaggtggcagtggatcaggcacagtatttacactgaaaatcagcagagtggagntgaggagtggttgggttacttagtagcagtgcaagtctactaacaacctcgtcgcggtactttcggacccgtcgggaaccgaaaaggtggaagaactacgaaaacgaacgtgtacgctcgacaccatctcgtcttccg

SEQ ID NO: 436970 - DNA, 501 bp, Homo sapiens
  misc_feature: GZ8MTXP02GT29Q.13.6.A06.1.454.CMB.2.raw
  modified_base (423)..(423): a, c, t, g, unknown or other
  modified_base (493)..(493): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggttatactgcatgcaagctntacaactctgcgactttcggccctgggaccaaaagtggagatacaaaacgaactgtaggctcgcaacctntctctctc

SEQ ID NO: 436971 - DNA, 551 bp, Homo sapiens
  misc_feature: GZ8MTXP02H8VU6.13.6.A06.1.454.CMB.2.raw
  modified_base (384)..(384): a, c, t, g, unknown or other
  modified_base (387)..(387): a, c, t, g, unknown or other
  modified_base (392)..(392): a, c, t, g, unknown or other
  modified_base (395)..(395): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagacgcctcctgcatagaatggatataatattggattgtatctgcagaggcagggcacgtccccacaactctgatctagttggggttactagtcgggccgtccggggtccctaagaggttcaggtggcaggtggatcgaggcactagtattttacactagaaatcagnagngtggnggngtaggagtagttggttggggtttatagtgctagtgacagctactacactcgtgcggttaccgttcgcccgtacggaaccgtaaggtggacaaacgtaccgtaaaacgacgttgggtacgtcgtacggacctaccgtatccgttcgttactttaccg

SEQ ID NO: 436972 - DNA, 587 bp, Homo sapiens
  misc_feature: GZ8MTXP02JAJGQ.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaatgatataactattggattggtatctgcagaggccagggcacgtccccacactcctgatctagttggggtctaagtcgggccgtcccggggtacctaacgaggttcaggtggcagtggatcgagcacagtatttacactagaaatcagcagagtggagcgtaggaggtagttggtttaggggtttattacgtgacgtagtcgacaagtcttactaacctaaccgttcgtacggtccggttaccgtttccgggcccgtacgggtaaccgtaaaagggtaggaacgtaacgtaacgaaaacggtaacgttaggtacggcgtacgaccgtacctacttaccgttcggttacctttccg

SEQ ID NO: 436973 - DNA, 584 bp, Homo sapiens
  misc_feature: GZ8MTXP02H9KYE.13.6.A06.1.454.CMB.2.raw
  modified_base (395)..(395): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccctggagacgccggcctccatctcctgcaggtccagtcagagcctcctgcatagaaatggatataatattggatgtatctgcagaggcagggcacgtccccacaactcctgatctagttggggttactaagtcgggccgtccgggtaccctaagtcggtcaggtggcagtggatcgaggcactagtactttaacactagaaaatcagcagagtggagntaggagtagtggttagggttactagtgtactagtggacagtctactactaaaccgtcgtagccggttaacgttccggtacccgtacgggaaccaaaagggttcggaagtaacgtaaacgtaaaacggtaccgttagggttaaccggcttacggaccaaacctactttaccgttacggtttacctttccg

SEQ ID NO: 436974 - DNA, 621 bp, Homo sapiens
  misc_feature: GZ8MTXP02F9QT5.13.6.A06.1.454.CMB.2.raw
  modified_base (282)..(282): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagagccaggcacgtccccanactctgatctagttgggttactaagtcggccgtccggggtacctaagtaggttcagtggcagtggatcgaggcacagtatttacactagaaaatcagcagagtggagcgtagaggtagttggtttaggggttattacgtgactagtagactaagtacctacgtaaccctaaaccgttcgtacgggtaccggttaaccgttttccggggtaccccgtaacggggtaaacccgtaaaaggttagggaaacgtaaacgttaaacgaaaaaccggtaaaccgtgggttacgggaaccgttacggaccgtaaaccctagttaccttacggtttcccttttaccg

SEQ ID NO: 436975 - DNA, 593 bp, Homo sapiens
  misc_feature: GZ8MTXP02JICKQ.13.6.A06.1.454.CMB.2.raw
  modified_base (133)..(133): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagngggaatattgtgatgactcagtctccactctacctgcccgtcacccctggagagccggcctccatctcctgcaggtccagtcagagcctcctgcatagaaatggatataactatttggattggtatctgcagaggccagggcacgtccccacaactcctgatctagttggggttactaagtccgggccgtccggggtccctaacgaggttcaggtggcgagtggatcaggcacgagtatttacactagaaaatcaagcgaggaggtaggaggtcgtaggaggtagttgggtttaggggtttattacgtgacgtagtcgacgaagtccgtactaacgaaccgtcgtacggtccggtaccgtttccgggaccgttagggaacccgtaaaaggtggaacgaacgttaccgaaaacgtaacgttcggcggtctacggacacctagttccgttcgtacgtttacc

SEQ ID NO: 436976 - DNA, 543 bp, Homo sapiens
  misc_feature: GZ8MTXP02GNBS0.13.6.A06.1.454.CMB.2.raw
  modified_base (282)..(282): a, c, t, g, unknown or other
  modified_base (424)..(424): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaatggatataactattggattggtatctgcagaggccagggcagtccccanaactcctgatctagtttggggtctaagtccggccgtccggggtcctaacgaggttcagtggcaggtggatcaggcacagtatttacatagaaaatcagcagagtggaggctggaggtagtggtttggggtttacttagtggnagtagacgacgtactactacctacctacgtcgtcgtacgttccggtaccgtacggtaacgtaagtaggacgaacgtaacgaacgtaacgtacgtcgtcgtacgacacactctcgtactc

SEQ ID NO: 436977 - DNA, 643 bp, Homo sapiens
  misc_feature: GZ8MTXP02JLXQI.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccgagggcacgtccccacaactcctgatctagttggggttctaagtccgggcctccggggtccctaacaggttcagtgcagtgatcgagcacagtatttacactagaaaatcagcagagtggagcgtagaggagttgggtttaggggtttattacgtgacgtagtcgacgtaaacgtccttacctaaacctaaacccttcgtacggtacccgggttaacccgtttttcccggggacccccgttaacgggggtaaaccccgtaaaagggttacgggaaacggtaaacgttaaaccgaaaaaccggtaaaccgttagggtacgggtaaccgttacggaaccctaacccgtaactttccgttcggtttacctttacccg

SEQ ID NO: 436978 - DNA, 590 bp, Homo sapiens
  misc_feature: GZ8MTXP02GYZYV.13.6.A06.1.454.CMB.2.raw
  modified_base (283)..(283): a, c, t, g, unknown or other
  modified_base (335)..(335): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctaccttcccgtcacccctggagagccggcctccatctcctgcaggtccagtcagagcctcctgcatagaaatggatataactattggattggtatctgcagaggcagggcacgtccccanaactcctgatctagttggggttactaagtccgggcctccggggtccctaagnggttcagtcggcagtgatcaggcacagtatttacactagaaaatcagcagagtggaggctaggaggtagttggtttagggggtttattacgtgtactagtggactaagtccttactaaccaaccttcgtacggtacggttacgtttccgggacccgtaggggaacctaaaacggtgggaaagtaacgtaacgaaaacgtaaccgttggtacgggtactcggacctaacgtacttccgtacgtttccttactaccg

SEQ ID NO: 436979 - DNA, 550 bp, Homo sapiens
  misc_feature: GZ8MTXP02JX0FP.13.6.A06.1.454.CMB.2.raw
  modified_base (282)..(282): a, c, t, g, unknown or other
  modified_base (372)..(372): a, c, t, g, unknown or other
  modified_base (455)..(455): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggcagggcagtccccanaactcctgatctagttggggttctaagtccgggcctccggggtacctaacgacggttcagtggcaggtggatcgaggcacagtactttanactagaaaatcagcaagagtaggaggctggaggtagttggtttaggggtttattacgtgcagtgacagctactacaaccttgngtcggtactttcggcccgtagggacctaaaaggtcggaagtactacgaaaacgtacgtaggtcggcgtcgaccactatccgttacgtactttccg

SEQ ID NO: 436980 - DNA, 532 bp, Homo sapiens
  misc_feature: GZ8MTXP02G2GHS.13.6.A06.1.454.CMB.2.raw
  modified_base (285)..(285): a, c, t, g, unknown or other
  modified_base (334)..(334): a, c, t, g, unknown or other
  modified_base (392)..(392): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcacgtccccanaactcctgatctagttggggttctaagtcgggcctccggggtcctaagnggttcagtgcagtggatcaggcacagtatttacactagaaaatcagcagagtggaggntaggaggtagtggttaggggttatacgtgctatgacaagtctactaccaaccgtctacggcgtacgtttccggcccgtagggaaccaaaggtggacgatacgaaacgaactggtagcgtcgacaccatctcgtacttacc

SEQ ID NO: 436981 - DNA, 564 bp, Homo sapiens
  misc_feature: GZ8MTXP02IZTTH.13.6.A06.1.454.CMB.2.raw
  modified_base (330)..(330): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcacgtccccacaactcctgatctagttgggtctaagtcggcctccgggtcctaacgnggtcagtgcagtggatcgaggcactagtatttacactagaaaatcagcagagtggagcgtgaggtagttggttaggggtttatacgtgctagtgtacgaagccttactaacaaccgttctcggtaccggttacgtttccgggcccgtaacggggtaacccaaaagggttgggaaaggtaacttaacgaaaacgtaaacgtcggtggctaggaccacctagtctacgtctttacc

SEQ ID NO: 436982 - DNA, 566 bp, Homo sapiens
  misc_feature: GZ8MTXP02JQCLZ.13.6.A06.1.454.CMB.2.raw
  modified_base (291)..(291): a, c, t, g, unknown or other
  modified_base (338)..(338): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatcctcctgcaggtccagtcagacgcctcctgcatagaaatgatataactattggattggtatctgcagagcagggcacgtccccacactccngatctagttggggttactaagtccgggaccgtccggggtacctaagnggttcacggtggcaggtggatcgaggcaacgtagttactttacattagaaaatcagcaggagtgggacgtgtaggaggtagttgggtttaggggtttattacgtgctagtggacaagtccttacaactacgtcgtcggacggttaccgttccggaccgttagggaaccaaagggtggaacgtactacgaaacgtacgtgtacgcgtcgaccactctactcgttcttac

SEQ ID NO: 436983 - DNA, 640 bp, Homo sapiens
  misc_feature: GZ8MTXP02I3N6U.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggcagggcacgtccccacaactcctgatcgtagttggggttactaagtccgggccgtccggggtaccctaacgaggttcagtggcaggtgatcgaggcacagtatttacactagaaaatcagacagagtgggaggcgtaggaggtagttgggtttaggggtttattacgttaggctaagtcggactaaggtcttacctaacctaaccgttcgtacggtaccggggttaccttttccgggggaccccgtacggggtaaacccgtaaaagggttcggggaaacgtaaacgttaaaccgaaaaccggtaaaccgttagggttcgggaaccgttacggaccctaaacccgttacgttaccgttacgtttacctttaccg

SEQ ID NO: 436984 - DNA, 558 bp, Homo sapiens
  misc_feature: GZ8MTXP02H7MVQ.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcaccctggagacgcccggcctccatcctcctgcaggtccagtcagacgcctctgcatagaaatggaatataactattggattggatctgcagagcaggcacgtccccacaactctgatctagttgggtactagtccggccgtccgggtcctaacgtggttcacggtgacagtggatcgacggcaacgaagtatttacactagaaaatcaagcaggaggtggaaggcgtaggagtagttggttggtagtttatacgtgatagtgactagcttacaacgtactcgtgtaccggttacgttccggacccgttacggaaaccgtaggtagaacgtactaaaccgaaacgtacgtaggtaagtcgacgacaaccgtctacgttcgtcc

SEQ ID NO: 436985 - DNA, 584 bp, Homo sapiens
  misc_feature: GZ8MTXP02HVPMS.13.6.A06.1.454.CMB.2.raw
  modified_base (258)..(258): a, c, t, g, unknown or other
  modified_base (280)..(280): a, c, t, g, unknown or other
  modified_base (285)..(285): a, c, t, g, unknown or other
  modified_base (324)..(324): a, c, t, g, unknown or other
  modified_base (381)..(381): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagacgcctcctgcatagaatgatataactattgattggtatcngcagagccaggcacgtccccanactcngatctagttgggtctagtccgggctccgggtcctaacgnggttcagtgcagtgatcgaggcatagtatttacactagaaatcagcagagtggaggntaggaggtagttgggttacggggtttattacgtgtgtattggactaacgtctacctaaccaaccgttcgtacggtccggttaccgtttcccgggacccgttacggggaaacccgtaaaagggttggaacgtaaacgtaaccgaaaacgtaaccgttggtcgggtaacttcggacctacctacgttccttcgtttaccttaccg

SEQ ID NO: 436986 - DNA, 520 bp, Homo sapiens
  misc_feature: GZ8MTXP02GK8YU.13.6.A06.1.454.CMB.2.raw
  modified_base (332)..(332): a, c, t, g, unknown or other
  modified_base (390)..(390): a, c, t, g, unknown or other
  modified_base (412)..(412): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactattggattggtatctgcagaggccagggcagtccccacaactcctgatctagttggggttctaagtcgggcctccggggtccctaagnggttcagtgcagtggatcgaggcacagtatttacactagaaaatcagcagagtggagntgagatggttgggttatactgnatgcaagctactaaccaacctctacggcggtacgttccggcccgtagggaacctaaaggtggaacgatacgaaaacgacgtgtggcgtcgacaccatctacgtcttac

SEQ ID NO: 436987 - DNA, 589 bp, Homo sapiens
  misc_feature: GZ8MTXP02JB0SK.13.6.A06.1.454.CMB.2.raw
  modified_base (277)..(277): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaatggatataactattgattggatctgcagagcaggcagtccccanactctgatctatgggttactaagtccgggcctccggggtcctaacgtaggttcagtgcagtggatcgaggcactagtatttacactagaaaatcagcagagtggaggctaggaggtagttggtttaggggtttatacgttgacgtatgacaagtctactacgaaccttcgacggtacggtaccgtttccgggacccgttacggggaacccgtaaagggttacgggaacgtaacgttaaccgaaaacggtaaaccgttggttaacggcgttacggacctaaccgtaacttaccgttcggtttacctttacccg

SEQ ID NO: 436988 - DNA, 639 bp, Homo sapiens
  misc_feature: GZ8MTXP02F2DC1.13.6.A06.1.454.CMB.2.raw
  modified_base (280)..(280): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgccggcctccatctcctgcaggtccagtcagagcctctgcatagaatgatataatattggatgtatctgcagacgcagggcacgtccccaanaactcctgattcgtagttcggggttactaacgtccgggtcccgtccggggtaccctaagtaggttcaggtggcaggtggactcgaggcatagtatttacataagaaaatcgaagacgaggtaggtaggaggtcgtaggaggtagttgggtttaggggtttattacgtagtactagtcgaacgtagtacctaccgtaaacctaaccgttcgtacggtacccggttacggtttcccgggtacccgttaacgggggaaaacccgtaaaagggttaggggaaacgtaaacgtaaaccgtaaaacgtaaacgttgggtacgtaacgttcgacctaccgtaacgttcttacgtttacctttaccg

SEQ ID NO: 436989 - DNA, 557 bp, Homo sapiens
  misc_feature: GZ8MTXP02F7K38.13.6.A06.1.454.CMB.2.raw
  modified_base (285)..(285): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgccggcctccatctcctgcaggtccagtcagacgcctctgcatagaaatgatataactagttgattgtatctgcagacggcgagggcacgtccccanactcctgatcgtagttgggttctaagtccgggccgttcccggggtacctaagtggttcgacggtggcaggtggactcgaggcactagtactttacactaagaaatcagcgagaggtggagcgtaggaggtagttgggtttagggtttactacgtagacgtagtgacagtctactactaccgcgtcgtacgtccgttccggaccgtacggaacgaaggtggaacgtagtaacgaaacgtacgtggacgcgtcgactactatcgtcgtcttacg

SEQ ID NO: 436990 - DNA, 572 bp, Homo sapiens
  misc_feature: GZ8MTXP02FET72.13.6.A06.1.454.CMB.2.raw
  modified_base (284)..(284): a, c, t, g, unknown or other
  modified_base (334)..(334): a, c, t, g, unknown or other
  modified_base (360)..(360): a, c, t, g, unknown or other
  modified_base (395)..(395): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactatttggattggtatctgcagaggccagggcagtccccanaactcctgatctagttggggttacaagtcggggcctccggggtcctaagnggttcagtgcagtggatcgaggcacngtatttacactagaaaatcagcaggagtggacggngtaggaggtagttgggtttagggttattacgtgacagtgacagtcctactaaccaaccttcgtcggtcggtaccgttccgggacccgtacgggaaacgtaaaaggtggaaacgtaacgtaaccgaaaacgtaacgtggtacggcgtacgaccacctagttccgtacgttacctttac

SEQ ID NO: 436991 - DNA, 526 bp, Homo sapiens
  misc_feature: GZ8MTXP02ILLVX.13.6.A06.1.454.CMB.2.raw
  modified_base (280)..(280): a, c, t, g, unknown or other
  modified_base (375)..(375): a, c, t, g, unknown or other
  modified_base (386)..(386): a, c, t, g, unknown or other
  modified_base (482)..(482): a, c, t, g, unknown or other
  modified_base (506)..(506): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatgatataactattgattggatctgcagagccaggcacgtccccanactctgatctagttggggtctaagtccgggcctccggggtacctagaggttcagtgcaggtgatcgagcacagtactttacactagaaaatcagnagagaggaggngtagaggtagttgggttagggtttatagtgctaagtgactacgtctaccgtaaccaaccttcgtacgtcggtacttcggccgtaggaccgtaaagnggacagtacgaaacgacgtgacgntacgacacatcgtcgtactc

SEQ ID NO: 436992 - DNA, 590 bp, Homo sapiens
  misc_feature: GZ8MTXP02HDZHU.13.6.A06.1.454.CMB.2.raw
  modified_base (244)..(244): a, c, t, g, unknown or other
  modified_base (254)..(254): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagcctgcctccatctcctgcaggtccagtcagacgcctctgcatagaatgatatactnttgattgatngcagagcgaggcacgtcccacactcctgatcgtagttggggttactaaggtccgggtcccgttaccggggtaccctaaacgtacggttcccgaggttcggaccgtaggtggtaaacttcgacgggtctaacgtagttaacttttaacgaacgttagaaaaactcgagacgagaggtaggagcgtaggaggtaaggttgggtttaggggtttacttagtaggtactagtgacgagtactacgtaccaactcgtcgtacggtacgttccggcccgtacgggactaaaggtacgagaactacgaaaacgcgttagcgtcgacgacactacgtctacttc

SEQ ID NO: 436993 - DNA, 504 bp, Homo sapiens
  misc_feature: GZ8MTXP02FVXGM.13.6.A06.1.454.CMB.2.raw
  modified_base (333)..(333): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccacaactcctgatctagttggggttctaagtcgggcctccggggtccctaagnggttcagtggcagtggatcaggcacagtatttacactagaaaatcagcagagtggagctgaggtagtggttgggtttatactgcatgcaagctactacacctctggcgtacttcggcctaggaccaaagtggaacgatacaaacgactgtggctgacaccgatctgtcttc

SEQ ID NO: 436994 - DNA, 651 bp, Homo sapiens
  misc_feature: GZ8MTXP02JMC7S.13.6.A06.1.454.CMB.2.raw
  modified_base (288)..(288): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatcctcctgcaggtccagtcagacgcctcctgcatagaaatggatataactattggattggtatctgcaggaggcgagggcacgtccccanaactcctgatctagttcggggttactaacgtccgggccgtcccggggtaccctaacgtaggttcacggtggctaggtggatcgacggcacgtagttactttacagtaagaaaatcgaagacgaaggtaggtagggaggtcgtaggtaagggtagtttgggtttaggggtttattacgtgacgtagttcggaacgtaagtccttaccttaaaccgtaaccgtcggttacggtacccgggttaaccgtttcccggggaacccgtaacgggggaaaccgtaaaaggggtcggaaacgtaacgttaaacgaaaaccgtacgttggacggtaactacggacctaccgtactcgttacgtctttaaccg

SEQ ID NO: 436995 - DNA, 652 bp, Homo sapiens
  misc_feature: GZ8MTXP02JUKSI.13.6.A06.1.454.CMB.2.raw
  modified_base (265)..(265): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagnggccagggcacgtccccacaactcctagatctagttggggttactaggtccgggccgttcccggggtaccctaacgaggttcacggtggctagtcgggatcgaggcaacgtagttactttacagtagtaaaatcgagacgaggaggtgggaggcgtaggaggtagttggggtttagggtttacttacgtagctagtcgacgtaacgtcttaacctaacctaaccgttcggtacggtacccggttaaccggttttcccggacccggtaacgggggtaaaccgtaaaacggggtacgggaaacgtaacgttaaaccgaaaacggtaaccgttggggtacggtaaccgtacggaccctaaccgtacttaccggttcgtttacctttaccg

SEQ ID NO: 436996 - DNA, 552 bp, Homo sapiens
  misc_feature: GZ8MTXP02FY587.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaatgatataactattgattggtatctgcagacggcagggcacgtccccacactctgatctagttggggtctaacgtccgggccgttcccggggtcctaagtaggttcaggtgcagtggatcgaggcacgtagtatttacacttagaaaactcaagcagagtggagcgtagaggtattaggtttagggttattagtgctatgacatctactaaccaccttcgtcggtacggtaccgtttccggacccgttagggaaaccgtaaggtacggaagaactacgaaacgtaaccgtggtggctacggactaccatctacgttacttc

SEQ ID NO: 436997 - DNA, 494 bp, Homo sapiens
  misc_feature: GZ8MTXP02GHCM1.13.6.A06.1.454.CMB.2.raw
  modified_base (382)..(382): a, c, t, g, unknown or other
  modified_base (419)..(419): a, c, t, g, unknown or other
  modified_base (432)..(432): a, c, t, g, unknown or other
  modified_base (475)..(475): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaagtcgggcctccggggtcctaacaggttcagtggcagtggatcaggcacagtatttacactgaaaatcagcagngtggaggctgaggtatggttgggtttatactgcatgnagctactacactntgcggacttcgcctggaccaaaggtgagatacaacgaacgtgnggctgcaccatctgtcttc

SEQ ID NO: 436998 - DNA, 605 bp, Homo sapiens
  misc_feature: GZ8MTXP02FUJG4.13.6.A06.1.454.CMB.2.raw
  modified_base (282)..(282): a, c, t, g, unknown or other
  modified_base (287)..(287): a, c, t, g, unknown or other
  modified_base (328)..(328): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctcgcccgtcaccccgtggagacgccggcctccatctcctgcaggtccagtcagacgcctctgcatagaatgatataactattgatgtatctgcagaggccgaggcacgtccccanactcngatctagttgggtctaacgtcgggcctccgggtacctaagnggtcagtgacagtggatcgaggcactagtaactttacactaagaaaatcaagtcgagaggtaggaggtcgtaggaggtagttaggggtttagggtttaacttacgtagacgtagttagacgtaacgtactactaaccgtaacctcgtcggtaccgtaccgtttaccgggtaccgtaacgggtaaccgtaaaaggtacggtaacgtaaactaaccgtaaaaccgtaaccgttgggtacgaaccgtacggacctaacctagttccttcgttactttacc

SEQ ID NO: 436999 - DNA, 620 bp, Homo sapiens
  misc_feature: GZ8MTXP02GZ35X.13.6.A06.1.454.CMB.2.raw
  modified_base (342)..(342): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagacgcctcctgcatagaaatggatataactattggattggtatctgcagaggccgagggcacgtccccacaactcctgatctagttggggttactaagtccgggccgttccggggtaccctaacgnggttcaggtggcaggtggatcgaggcacagtatttacacttagaaaatcgagtcaggtagtagggaggcgtaggagggtagttaggggttttaggggtttaagttacgtagtacgtaagtaggtacgtaacggtccttactaaaccgtaacctcggtcggtacggtaccgtttccgggcccgttacgggaaccgtaaaggtaggaacgtaacgtaacgtaaacgtaacgttcggtaggtccgtacgacctaccgtattccgttacggttcctttaccg

SEQ ID NO: 437000 - DNA, 543 bp, Homo sapiens
  misc_feature: GZ8MTXP02IESND.13.6.A06.1.454.CMB.2.raw
  modified_base (286)..(286): a, c, t, g, unknown or other
  modified_base (398)..(398): a, c, t, g, unknown or other
  modified_base (532)..(532): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagacgcctcctgcatagaaatggaatataactatttggattggtatctgcagaggccagggcagtccccanaactcctgatctagttggggtctaagtcggggcctccggggtccctaagaggttcagtgcagtggatcgaggcacagtattttacactagaaaatcagcagtaggtggaggngtgaggtagttgggttaggggtttactagtgacatcgacagctactaccaacctcgtcgcggtactttcgggaccgtagggaaccaaaaggtggaaagtacaacgtaaacgaactgtacggctaggacaacctntcttcgtactc

SEQ ID NO: 437001 - DNA, 569 bp, Homo sapiens
  misc_feature: GZ8MTXP02I71VW.13.6.A06.1.454.CMB.2.raw
  modified_base (400)..(400): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaatggatataactattggattggtatctgcagaggccagggcacgtccccacaactcctgatctagttggggttactaacgtcgggccgtccggggtaccctaacgtaggttcaggtcggcagtggatacgaggcacagtatttacactagaaaatcagcagagtggagngagaggtagttggttaggggttattacgtgactagtcgacagtctacctaactaacctcgtcggtaccgtacgtttcggcccgttacgggaaccgtaaaggtagaacgaactaacgaaaacgtaacgtggtacggaacgtcggaccactacgtcgtcgttactttaccg

SEQ ID NO: 437002 - DNA, 575 bp, Homo sapiens
  misc_feature: GZ8MTXP02F8EJV.13.6.A06.1.454.CMB.2.raw
  modified_base (333)..(333): a, c, t, g, unknown or other
  modified_base (391)..(391): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttactaagtcgggcctccggggtccctaanaggttcagtgcagtggatcaggcacagatttacatagaaaatcaagcagagtggaggngtagaggtagttggtttagggtttattacgtgactagtgacgaagtctactaaccaccttcgtacggtcggtacgttccggtacccgtacgggaaaccgaaaggtaggaacgtaacgtaaaccgaaaacgtaacgtggtacggtaaccgtacggaccactacgttccgttacgttacctttacg

SEQ ID NO: 437003 - DNA, 577 bp, Homo sapiens
  misc_feature: GZ8MTXP02F8OTK.13.6.A06.1.454.CMB.2.raw
  modified_base (405)..(405): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaatggatataactattggattggtatctgcagaggccgagggccacgtccccacaactcctgatctagtttggggttactaacgtccggggcccgttcccggggtaccctaacgagggttcaggtcggctaggtggatcgaggcacagtatttacatagaaaatcagcagagnggagcgtaggaggtagttgggttaggggttattacgtaggcatggactaagtctactaaccacctgtacggcggtacgttccgggaccgtagggaaccgtaaaggtaggacgtaactaacgaaacgtaacgtcggtaggcgtcggacctaccgtatccgtcgttacttaccg

SEQ ID NO: 437004 - DNA, 523 bp, Homo sapiens
  misc_feature: GZ8MTXP02HRHTB.13.6.A06.1.454.CMB.2.raw
  modified_base (284)..(284): a, c, t, g, unknown or other
  modified_base (331)..(331): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatggatataactattggattggtatctgcagaggccagggcagtccccanaactcctgatctattggggtctaagtcgggcctccggggtcctaacnggttcagtggcagtcggatcaggcacagtatttacacttagaaaatcagcagagtgggagcgtgaggagtggttggggttagttacgtagtctatgtcgagactactacaacctctcgtcggtacgttccgtccgtacggacgaacggtaggaggatacaaacgaacgtagtgcgtcgcacatctctcttcc

SEQ ID NO: 437005 - DNA, 560 bp, Homo sapiens
  misc_feature: GZ8MTXP02J2B0E.13.6.A06.1.454.CMB.2.raw
  modified_base (258)..(258): a, c, t, g, unknown or other
  modified_base (411)..(411): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtggaatattgtgatgactcagtctccactctacctgccccgtcacccctggagagccggcctccatctcctgcaggtccagtcagagcctcctgcatagaaatggatatactattggattggatntgcagaggcaggcagtccccacaactcctgatctattgggttctaagtccggggccttcccggggtccctaacgacggttcacgtggcagtgggatcgagggcaacagtatttttacactagaaatacagcaggagtggaggctaggaagggnttgggtttagggggtttatttaacgtgctaattgacgtaagctctaacctaacctctgaccggggtactttccggggacccttacggggaaccaaaggttaggacgaactacgtaaaacgactgtggctgacacctatctctctttacc

SEQ ID NO: 437006 - DNA, 530 bp, Homo sapiens
  misc_feature: GZ8MTXP02GM5IB.13.6.A06.1.454.CMB.2.raw
  modified_base (282)..(282): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattgtatctgcagagccaggcacgtccccanaactcctgatctagttggggtctaagtcgggccgtccggggtcctaagaggttcagtgcagtggatcgaggcacagtattttacactagaaaatcagcaagagtgggagcgtagaggtagttggtttaggggtttacttacgtggctagtgcgaagctactaccacgtctgtcggtacgttcggcccgtagggaaccaaaggtaggagatacgaaaacgtacgtgtggaactcgcactatcttctctc

SEQ ID NO: 437007 - DNA, 568 bp, Homo sapiens
  misc_feature: GZ8MTXP02H6BSQ.13.6.A06.1.454.CMB.2.raw
  modified_base (380)..(380): a, c, t, g, unknown or other
  modified_base (384)..(384): a, c, t, g, unknown or other
  modified_base (394)..(394): a, c, t, g, unknown or other
  modified_base (401)..(401): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccgtggagacgccgcctccatctcctgcaggtccagtcagacgcctctgcatagaaatgatataactattgattgtatctgcagaggcagggcacgtcccaacaactcctgatctagttgggttctagtcggccgtccggggtaccctaagaggttcagtggacaggtggatcgaggcacgtagtattttacactagaaatnacgnagagtgaggntagaggngttggttagggttacttagtggtacagtgtacgagtctacgtactaaaccgtcgtcggacgttacgtttacggacccgtaggtaaccgaaaggttggactaacgtacgaaaacgaaccgttggacgttcgtacggaccaacctataccggttacgtttcctttaccg

SEQ ID NO: 437008 - DNA, 678 bp, Homo sapiens
  misc_feature: GZ8MTXP02JFSY1.13.6.A06.1.454.CMB.2.raw
  modified_base (282)..(282): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatcctcctgcaggtccagtcagacgcctcctgcatagaatgatataactattgattgtatctgcagagccagggcacgtccccaanactcctgatctagttgggttactaacgtccggccgttccggggtaccctaacgtggttccaggtcgcgtacgtggatacgagggccaacgtaagttaaactttttaccgaacgttaaagaaaaactccgaaagacgaaggtagggttagggaaggtagttaggaagggttagttttagggggttttaacggggtttaaattccgttaggactaaggttaggactaaacggtccttaacctaaacctaacccgttcgtaccggtaccgggttaccgtttacccggggacccgtaacggggtaaaaccgtaaaacgggttaggaaacggtaactaaacggaaaacgtaacgttaggcgaacgttcgaccgtaaccacttccgttacgtcctttaaccg

SEQ ID NO: 437009 - DNA, 776 bp, Homo sapiens
  misc_feature: GZ8MTXP02GEGZG.13.6.A06.1.454.CMB.2.raw
  modified_base (253)..(253): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccgtggagacgccggcctccatctcctgcaggtccagtcagacgcctctgcatagaatgatatactattgatgtanctgcagacgcagggcacgtccccacaactcctagatctagttcggggttactaacgtccggggtcccgttacccggggtaccctaaacgtacggtttcgaggttcggaccgtaggttaggaacgttacgaacgggccaaacgtaacggttaaacttttttaaaccgaaaccgtttaaagaaaaaacttccgaaacgacgtaaaggtaacggggttagggaacgggtacgttagggtaaggggttaaggttttagggggtttttaacgggggttttaaatttacgttaggtaccgtaagttacggaaccgtaacggttaccttaaccttaaacccgtaaccgttccgtaccgggtaccgggttaacccggttttcccggggaccccggttaacgggggaaaacccgtaaaaggggttacgggaaacggtaaacgttaaaaccggaaaaccggtaaaaccggttggttaaccgggcgttacggaccgaaacccttaacgttaccgttaccgtttcctttaacccg

SEQ ID NO: 437010 - DNA, 535 bp, Homo sapiens
  misc_feature: GZ8MTXP02HWBMX.13.6.A06.1.454.CMB.2.raw
  modified_base (247)..(247): a, c, t, g, unknown or other
  modified_base (251)..(251): a, c, t, g, unknown or other
  modified_base (257)..(257): a, c, t, g, unknown or other
  modified_base (262)..(262): a, c, t, g, unknown or other
  modified_base (277)..(277): a, c, t, g, unknown or other
  modified_base (282)..(282): a, c, t, g, unknown or other
  modified_base (322)..(322): a, c, t, g, unknown or other
  modified_base (334)..(334): a, c, t, g, unknown or other
  modified_base (336)..(336): a, c, t, g, unknown or other
  modified_base (368)..(368): a, c, t, g, unknown or other
  modified_base (373)..(373): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgccggcctccatcctcctgcaggtccagtcagacgcctctgcatagaaatgatataatnttgntgatcngcagngcaggcacgtcccanactcngatctagttgggtactagtcggccgtccgggtacctaagnggtcagtgcagngncgagcagatatttacatagaaatcagcagagnggagngtagaggtagttaggttagggttatacgtgctaagtcgacaagtctaacctaacgaactcgtacggtcggttaccgttacgggcccgtagggaaaccaaaggtagagaacgtaaacgaaacgtacgtggtacggctagacctactacttcgtcgtttctacc

SEQ ID NO: 437011 - DNA, 648 bp, Homo sapiens
  misc_feature: GZ8MTXP02F06NM.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagacgcctcctgcatagaaatggataataacttattggattggtatctgcaggacggcgagggcacgtccccacaacctcagatctagtttggggtactaacgtccgggccgttccggggtaccctaacgtaggttcgagttgggactaggtaggactcgaggtcaacgtaagttaacttttacaactaagaaaaatcgaagacgaaggtaggagggaggtagtagggaagggttaggtttaggggtttagggggttttaaacttacgttagtacgtattaggacgtaagtacctactaacccgtactcgtggtaccggttacgtttccggaccgtagggtaaaccgtaaaagggtcggaaacgtaacgtaaacgtaaaacgtaaacgtggtacgggtctacgacctacctacgttcttcgtttacctttcg

SEQ ID NO: 437012 - DNA, 571 bp, Homo sapiens
  misc_feature: GZ8MTXP02G6HIN.13.6.A06.1.454.CMB.2.raw
  modified_base (286)..(286): a, c, t, g, unknown or other
  modified_base (291)..(291): a, c, t, g, unknown or other
  modified_base (294)..(294): a, c, t, g, unknown or other
  modified_base (378)..(378): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagagccggcctccatctcctgcaggtccagtcagagcctcctgcataagaaatggataataactattggattggtatctgcagagccagggcacgtccccanactcnatntagttgggtcagtcgggcctccgggtacctaagagtcagtgcagtgatcgaggcactagtatttaacactagaaaactcaaganaaggtagtagggaaggcgtaggaagggtagttggggtttacggggttattacgttagactaagtcgactaaggtactacgtaacctaactcgtaggtccgtacgtttccggccgttacgggaaaccaaaggtcggaaacgtacgtaaaccgaaaagtaacgtcgtaggctacgaccacacttcctagtcttac

SEQ ID NO: 437013 - DNA, 626 bp, Homo sapiens
  misc_feature: GZ8MTXP02GBDCD.13.6.A06.1.454.CMB.2.raw
  modified_base (287)..(287): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgcccggcctccatcctcctgcaggtccagtcagacgcctctgcatagaaatgatataactattggattgtatctgcagaggccgaggccacgtccccanactcctgattcgtagttcggggttactaacggtccggggtccgtcccggggtaccctaaggtacggttcaggtcggacaggtggatacgagggtccaacgtagttacttttaaccactaagaaaacttcgaagagaaggagggtagggaacggtcgtagggaagggttaaggtttggggttttagggggtttatttacgtggtacgtagtgactaaaggtccttacgtaacctaccgtcgtacggtacggtacgtttccggaccgtaggaaaccgtaaggtcggaatacgacgtaaaaccgacgttggacgtcgcgacctactacgtctcgtcgttacc

SEQ ID NO: 437014 - DNA, 576 bp, Homo sapiens
  misc_feature: GZ8MTXP02H5UY0.13.6.A06.1.454.CMB.2.raw
  modified_base (383)..(383): a, c, t, g, unknown or other
  modified_base (396)..(396): a, c, t, g, unknown or other
  modified_base (424)..(424): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccctggagagccggcctccatctcctgcaggtccagtcagagcctctgcatagaaatggatatactattggatgtatctgcagaggcagggcacgtcccacaactcctgatctagtggggttctaagtcggtcctccggggtaccctaagtcggttcagtggactagtggatcgaggcaacgtagtactttacactagaaaatcaancgagagtggaggntagagtagttggttagggttatagtagngtagtagtagtacgtactactaacgtaaccgtacgtcgtacggtaccgttaccggtaccggtacggtaacggtaaacggtaggtaacgtaacgtaacgtaaacgtaacgtacgtacgtaacgtacgacgtactacgtacgtacgttactacg

SEQ ID NO: 437015 - DNA, 637 bp, Homo sapiens
  misc_feature: GZ8MTXP02F8BHE.13.6.A06.1.454.CMB.2.raw
  modified_base (289)..(289): a, c, t, g, unknown or other
  modified_base (366)..(366): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcataagaatgatataactattgattggtatctgcagaggcaggcacgtccccacaactctgntctagttggggttactaagtccggggccgtcccggggtaccctaagtaggttcaggtcggcaggtggatcgaggcanagtattttacactaagaaaactcgagacgaaggaggtagggaggtcgtaggagggtagtttgggttttagggggtttattaacgtgactagtcgactaaagtccttacctaaacctaacccgttcgttacggtcgggtaacccgtttaccggggtaccccgtacggggaaacccgtaaaaggtagggaacggtaaacttaaacgaaaaccggtaacgttaggtacggtaacgtacgaaccgtaccgtaacttcgttacgtttcctttaccg

SEQ ID NO: 437016 - DNA, 642 bp, Homo sapiens
  misc_feature: GZ8MTXP02HYCBF.13.6.A06.1.454.CMB.2.raw
  modified_base (259)..(259): a, c, t, g, unknown or other
  modified_base (282)..(282): a, c, t, g, unknown or other
  modified_base (287)..(287): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtggatattgtgatgactcagtctccactctacctgccccgtcacccctggagacgccggcctccatctcctgcaggtccagtcagacgcctcctgcatagaatggatataactattggattggatcngcaggagccaggcacgtcccaanactcngatcgtagttcgggttactacgtcggtccctccgggtacctaacgaggttcaggtcgcaggtagatcgaggcagtaagttactttaccaacgttagaaaacttcaagcgaaggtagggtgggaggtcgtaggaagggtagtttagggttaggggtttacttagtagtcgaagttcgacgtaacggtctaaccgtaaccgtaccgttcgtcggtaccggttaccgtttaccgggaccccgtaacggggtaaaccgtaaagggtacgggaaactaaacgtaaccgtaaaacggtaaccgttaggtcgggtaaccgtacggtacctaaccgtaacttccgttacggtttacttacccg

SEQ ID NO: 437017 - DNA, 513 bp, Homo sapiens
  misc_feature: GZ8MTXP02JDNGM.13.6.A06.1.454.CMB.2.raw
  modified_base (284)..(284): a, c, t, g, unknown or other
  modified_base (428)..(428): a, c, t, g, unknown or other
  modified_base (479)..(479): a, c, t, g, unknown or other
  modified_base (504)..(504): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcacgtccccanaactcctgatctagttggggtctaagtccgggcctcccggggtcctaacgtaggttcagtgcagtggatcgaggcacagtacttttacactagaaaatcagcagagtggaggctagagattggttaggggttatacgtgcagtngaatctactacaactcgtgcgtacgttcgccctagggaccaaggtgagtanacgaaacgacgtgtgcgtcgctacntctcgtctc

SEQ ID NO: 437018 - DNA, 579 bp, Homo sapiens
  misc_feature: GZ8MTXP02J3OUY.13.6.A06.1.454.CMB.2.raw
  modified_base (245)..(245): a, c, t, g, unknown or other
  modified_base (256)..(256): a, c, t, g, unknown or other
  modified_base (261)..(261): a, c, t, g, unknown or other
  modified_base (278)..(278): a, c, t, g, unknown or other
  modified_base (328)..(328): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagacgcctctgcatagaatgatataactnttgattgatcngcagngccaggcacgtccccanactctgactgtagtgggttcaaggtccgggtcctccggggtacctaaagnggttcaggtggcaggtgatcgaggtcatagttatttacatagaaaatcagacgtagagtggaggtctaggagtagttggttaggggtttatacgtgtcagtcgactacgtcctactaacctaaccgttcgtacggtccggttaaccgttccggtacccggtaagggtaacccgaaaagggttcggaacgaacgttaacgaacgtaacgtggtacggaacctacggaccacgtacttccttcgttactcccg

SEQ ID NO: 437019 - DNA, 666 bp, Homo sapiens
  misc_feature: GZ8MTXP02IP0I7.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacggccggcctccatctcctgcaggtccagtcagacgcctcctgcaataagaaatggatataacttatttggattggtatctgcagaggccgaggcacgtccccacactcctagactcgtagttgggttactaacggtccgggtccgtcccggggtaccctaagtacggttcgacggtggctaggtggatcgaacggtccaacgtaagttaacttttaacgacgtaagaaaactccgaagacgaggtaggtagggaggtcgtaggtaggttagtttggggtttaggggtttattacggtagtacgtagtacgtacgtacggtccttaacccgtaacctaaccgttcgtacggtaccgggttaccgtttacccgggaccgtaacgggtaaaccgtaaagggttacggaacgtaaacgaaaccgtaaaacgtaacgtggttacggaacgtaccgactaccgttagtcgttcgttaccttacg

SEQ ID NO: 437020 - DNA, 558 bp, Homo sapiens
  misc_feature: GZ8MTXP02FJKVR.13.6.A06.1.454.CMB.2.raw
  modified_base (397)..(397): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatcctcctgcaggtccagtcagagcctcctgcatagaaatggatataactatttggattggtatctgcagagcagggcacgtccccacaactcctgatctagttggggttctaagtccggggccgtccggggtaccctaacgaggttcagtgcaggtggatcaggcacagtatttacactagaaaatcagcagagtggagntggagtattggttgggtttatacgtgtcatgacaagtctactaaccaacctcgtacgcggtacgtttccggcccgtaggggtaaacctaaaagggtcggaagtaacgtaccgaaaacgtaacctggtcggaactcggaccactacgtactcgttccttacg

SEQ ID NO: 437021 - DNA, 625 bp, Homo sapiens
  misc_feature: GZ8MTXP02GRFOD.13.6.A06.1.454.CMB.2.raw
  modified_base (279)..(279): a, c, t, g, unknown or other
  modified_base (284)..(284): a, c, t, g, unknown or other
  modified_base (288)..(288): a, c, t, g, unknown or other
  modified_base (323)..(323): a, c, t, g, unknown or other
  modified_base (346)..(346): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagacgcctctgcatagaatgatataactattgattgtatctgcagaggcaggcacgtccccanactcngatntagttgggtactacgtcggcctccgggtacctagngttcagtgctagtgatcgagcanagtactttacacgtaagaaactcgagcgaaggtagtacgggaggtacgtaggaggtagttgggtttagggtttatacgtgactagttgacgtaagtcctacctaaccgtaacttcggacggtaccggttaccgtttacccgggacccggttaacggggaaaccctaaaggggttagggaaacggttaaactaaccgtaaaaaccggtacggttacgggttaccggaacgttaccggaaccgtacccgttatttaccggttcgtttaacccgtttacccg

SEQ ID NO: 437022 - DNA, 597 bp, Homo sapiens
  misc_feature: GZ8MTXP02JAE1C.13.6.A06.1.454.CMB.2.raw
  modified_base (376)..(376): a, c, t, g, unknown or other
  modified_base (387)..(387): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtggaatattgtgatgactcagtctccactctacctgcccgtcacccctggagacgccggcctccatctcctgcaggtccagtcagacgcctcctgcatagaaatggatataactattggattggtatctgcagaggcagggcacgtcccacactcctgatctagttgggtactaagtcgggccgtccgggtacctaacgaggttcaggtgcagtgatcagcacagtatttacatagaaaatcancagagtggagngtagaggtagttcggttagggttactaagttacgtgataagttgacaacggtacctaacgtaactaaacccgttcgtacggtccggttaaccgtttccgggaccccggttaacgggaaacccgtaaagggtacggaaacgtaacgtaaccgaaaacgtaacgtggttaacggacttacggacctaaccgtacttacggtcgtttaacccg

SEQ ID NO: 437023 - DNA, 547 bp, Homo sapiens
  misc_feature: GZ8MTXP02IRO3H.13.6.A06.1.454.CMB.2.raw
  modified_base (351)..(351): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatgatataactattggattggtatctgcagaggccagggcacgtccccacaactcctgatctattggggttctaagtcgggcctccgggtcctacaggtcagtgcagtgatcagcanagtatttacactagaaaatcagcagagtgggagcgtagaggtagttggtttaggggtttatacgtgctatgactaagctactaaccaccgtcgtcgtacggtaccgtttcggacccgtaggggaaccaaagggtcggaagtaactaacgaaacgaaacgttggacggtcgtcgactaccagtcttcgttctttacc

SEQ ID NO: 437024 - DNA, 606 bp, Homo sapiens
  misc_feature: GZ8MTXP02IAEZJ.13.6.A06.1.454.CMB.2.raw
  modified_base (287)..(287): a, c, t, g, unknown or other
  modified_base (393)..(393): a, c, t, g, unknown or other
  modified_base (396)..(396): a, c, t, g, unknown or other
  modified_base (407)..(407): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgccggcctccatctcctgcaggtccagtcagagcctcctgcatagaaatggatataactattggattggtatctgcagaggccagggccacgtccccanaactcctgatcgtagttggggttcaacgtccgggcccgttcccggggtccctaagaggttcaggtcggcgagtggatcgagctaacagtatttacactagaaaatnagnagagtggaggngtagaggtagttgggtttaggggtttattacgtagctaagtgactaagtccttacctaaccgtaacctcgtacggtcggtacccgtttccgggacccgtaggaaaccgtaaaaggtcgggaacgaaacgttaaccgaaaacgtaacgtacggtcgggaacgtacggtaccaacccgtagttccttacgttcctttaccg

SEQ ID NO: 437025 - DNA, 639 bp, Homo sapiens
  misc_feature: GZ8MTXP02IH663.13.6.A06.1.454.CMB.2.raw
  modified_base (285)..(285): a, c, t, g, unknown or other
  modified_base (335)..(335): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccccggagacgcccggcctccatcctcctgcaggtccagtcagacgcctcctgcatagaatgatataatattggattgtatctgcaggagccagggcacgtccccanaactctgatctagttggggtactaagtccgggccgtccgggtcctaaagnggttcagtcggacaggtgatcgaaggcacgtagttaattttaaccaactaaggaaaatcgaaagacgtaaggaggtagggaggtacgttagggaagggttaggttttagggtttagggggttttaacttaacgtggactagttcggactaaacgtcttacgttaacctaacccgttcgtacggtccggttacgtttcccgggacccgttacgggaaccgtaaaaggttaggaacgtaacttaaaccgaaaaacggtcgttaggtcggactggtaccacgtacttcttcgtttacttacgtaccg

SEQ ID NO: 437026 - DNA, 608 bp, Homo sapiens
  misc_feature: GZ8MTXP02F6BVK.13.6.A06.1.454.CMB.2.raw
  modified_base (285)..(285): a, c, t, g, unknown or other
  modified_base (357)..(357): a, c, t, g, unknown or other
  modified_base (409)..(409): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctcgcccgtcaccccgtggagacgccggcctccatctcctgcaggtccagtcagacgcctctgcatagaatgatataactattgattggtatctgcgagagccagggcacgtccccaanaacctcctagactctaggttggggttactaagtccgggtccgtcccgggtacctaagaggttcacgtggacngtggatcgaggcaactagtactttacactaagaaaactcagacagagtaggnggatggagtagttaggtttaggttatgtagactagtcgtacgaagtcgtacctaacgtaacctcgttacggacggttaccgtttaccggggtacccgtaacgggtaaaccgtaaacgggtcggaaacgtaacgtaaacgtaaaacgtaacggtggacggtaacgtacgtacgtacctacttccgtacgttcttaacccg

SEQ ID NO: 437027 - DNA, 715 bp, Homo sapiens
  misc_feature: GZ8MTXP02JD47U.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgccggcctccatctcctgcaggtccagtcagacgcctcctgcatagaatggaatataacttagttggattggatctgcaggacggccgagggccacgtccccacacttctgacttacgttaggtttggggttactaacggtccggggtacccgttaccggggttacccttaaacgtacgggtttcacgggttgggaccgtaggtacggtactacggacggtcctaacgtagttaacttttaacgacgttaaagtaaaactccgaaagtaccgaaaggtagggtacggggaacggtcgtaggtaaggggttaggtttacgggttttaggggtttaacttacgtaggtactagtacgtaacgtaacgtctaacctaaccgtaaccgttcgtcggtaccggttaccgttaccgggacccggtaacggtaaaccgtaaagggtacggaaacgtaaactaaaccggtaaaacgtacggtacggtcggtaacgtacgaccgtaaccttgttaccgttacggtttcttaacccg

SEQ ID NO: 437028 - DNA, 686 bp, Homo sapiens
  misc_feature: GZ8MTXP02I4FJM.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcaccccgtggagacgccggcctccatctcctgcaggtccagtcagacgcctcctgacataagaaatggaatataacttagttggattggtatctgcaggaggccgagggccaccgtaccccaactaacctctagactcgttaggtttcggggttactaaacggtcccgggtacccgttccccggggtacctaacggtggttcgaggtcggcgtagtacggtataccgaaggcctaacgtaaagtttaacttttaaacgaagttaaacgaaaactcgaaagacgaaggtagggtaggggacggtagtagggtaaggggttaggtttaggggtttaaggggtttacttaacgtgtacgtaagtcgtaactaacgttcttaaccctaaccgtaaccgtcgtacggtaccggttaccggtttcccggaccgttacgggaaaaccgaagggttagaaacgacgttaaacgaaacgtaacgtggtacgtaacgtcgacacctagtctacttcttacc

SEQ ID NO: 437029 - DNA, 575 bp, Homo sapiens
  misc_feature: GZ8MTXP02G1PZI.13.6.A06.1.454.CMB.2.raw
  modified_base (267)..(267): a, c, t, g, unknown or other
  modified_base (285)..(285): a, c, t, g, unknown or other
  modified_base (290)..(290): a, c, t, g, unknown or other
  modified_base (359)..(359): a, c, t, g, unknown or other
  modified_base (396)..(396): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagcccggcctccatctcctgcaggtccagtcagacgcctcctgcataagaaatgatataatagttggattggtatctgcagnggccaggcacgtccccanactcngatctagttgggtctacgtccggccgtcccgggtacctaagtaggttcagtgacagtggatcgagcaanagttactttacatagaaaatcagagagagtaggaggngtagaggtagttggttagggtttatacgtgactagtgacaagtacttacctaacctaaccgttcgtacggtaccgttaccggttaccggtacccgtaacggggaaaccgtaaaggtggaaacgaacgtaaaccgaaacgtacgtagtcggaactcgactaacgtatcttacgttactcg

SEQ ID NO: 437030 - DNA, 647 bp, Homo sapiens
  misc_feature: GZ8MTXP02JEMUH.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcaccccgtggagacgcccggcctccatcctcctgcaggtccagtcagacgcctcctgcataagaaatggataattaacttagtttggattggtatctgcagacggcagggcacgtccccaacactcctagactcgttagtttggggttactaacggtccgggtcccgttcccggggtaccctaagtaggttcaggtcggctaggtgatcgagcacagttactttaacactaagaaaatcaagcgaaggagtagggaggtcgtaggtaggtaagtttggggtttagggtttatacgttgacgtagtagactaacgtctaacctaactaaccgttcgtcggtaccgggttaccgtttcccgggacccgtaacgggggtaaaacccgtaaaagggtcggaaacggtaactaaaaccggtaaaacgtaaacgtggttacgcgtacgacctacctatttcgtaccgttctttaaccg

SEQ ID NO: 437031 - DNA, 638 bp, Homo sapiens
  misc_feature: GZ8MTXP02JO3H9.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgcccggcctccatctcctgcaggtccagtcagacgcctcctgcatagaaatggatataactattggattgtatctgcaggagccgagggcacgtccccacactctgattcgtagtttggggtctaagtccgggtccgttcccggggtacccctaagacggtttcaggttcggactaggtggactcgaggcaactagtaatttaccaattagaaaactcgaagcaaggtagtgggagtgtaggaggtaagttgggtttaacgggttattacgtgactagtacgagtaactcgtacctaactaaccgtcgtacggtacggttaccgtttcgggaacccgtacgggtaaaaccgtaaagggtacggaaacggtaaactaaccggtaaaaccgtaaaccgtggttacggccgttacggacctaaacccgtactttaccgttacgttaccttacg

SEQ ID NO: 437032 - DNA, 745 bp, Homo sapiens
  misc_feature: GZ8MTXP02JYH0I.13.6.A06.1.454.CMB.2.raw
  modified_base (303)..(303): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtccaccctggagacgccggcctccatctcctgcaggtccagtcagacgcctcctgcataagaaatggaatataacttagttggattggtatctgcaggacggccgagggctacgtaccccacaactccngatcgttagttcggggttactaacggtccggggtcccgtacccggggttaccctaaacggtacgggtttacgaggtcgggacgtagggtaggtactccgagggccaacgtaaagtttaacttttaaccgaaacgttaacggtaaaaactcgacgtaacgaagggtaaggggttaggggacgggtccgtaggggtaagggttaagggttttaggggtttttagggggtttacgtttaacgtcgtacgtaagttcgaacgtaacggtcccttaaccgtaaaccctaacccgttcgtacggtacccggttaaccggtttcccgggtaccccggtaacggggtaaaccggtaaaacgggtacgggaacgtaaacggtaaaccgtaaaaccggtaacgtcgggtacggtcgtacggtacctacctcgttacttcgttccgtttaccg

SEQ ID NO: 437033 - DNA, 579 bp, Homo sapiens
  misc_feature: GZ8MTXP02GKYYF.13.6.A06.1.454.CMB.2.raw
  modified_base (252)..(252): a, c, t, g, unknown or other
  modified_base (290)..(290): a, c, t, g, unknown or other
  modified_base (295)..(295): a, c, t, g, unknown or other
  modified_base (466)..(466): a, c, t, g, unknown or other
  modified_base (514)..(514): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgccggcctccattctcctgcaggtccagtcagacgcctcctgcataagaaatgaatataacttntttggattggtatctgcagaggccaggcacgtccccanactcngatctagttgggttactagtccgggccgttcccgggacctaagacggttcaggtggcaggtgatcaggcatagtactttagactagaaaatcaagcaaggagtggagcgtaggagtagtcgggtttgggttaaattcgtgactagtgacagtacctactaaaccacgttcncggtacggttaccgttccgggccgtaggaaacctaaagggtcggaaanacttaacgaaaacgtacgtaggtaccggaatccggtaccaaacgtactcgtacgttactttaccg

SEQ ID NO: 437034 - DNA, 630 bp, Homo sapiens
  misc_feature: GZ8MTXP02IO3PW.13.6.A06.1.454.CMB.2.raw
  modified_base (328)..(328): a, c, t, g, unknown or other
  modified_base (351)..(351): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaatggatataactattggattggatctgcagaggccaagggcagtccccacaactcctgatctattggggtctaagtcggcctccggggtcctaagngttcagtgcagtggatcgagcanaagtacttttacactagaaaatcgatacagagtggaggcgtaggaggtagttggtttaggggtttattaacgtggtatagtacggtacctaaaggttcctaaccttacaaaccccgttacgttaccgggtccgggtttaacccgtttcccggggtaccccgttaacgggggtaaccccgaaaagggtttggaacggtaacttaaaccgaaaaccgtaaaccgttggttaacgggcttacggaaccgaccgttaacgtccgtttacgttccctttaaccg

SEQ ID NO: 437035 - DNA, 538 bp, Homo sapiens
  misc_feature: GZ8MTXP02GCE4J.13.6.A06.1.454.CMB.2.raw
  modified_base (245)..(245): a, c, t, g, unknown or other
  modified_base (253)..(253): a, c, t, g, unknown or other
  modified_base (259)..(259): a, c, t, g, unknown or other
  modified_base (275)..(275): a, c, t, g, unknown or other
  modified_base (280)..(280): a, c, t, g, unknown or other
  modified_base (321)..(321): a, c, t, g, unknown or other
  modified_base (332)..(332): a, c, t, g, unknown or other
  modified_base (368)..(368): a, c, t, g, unknown or other
  modified_base (378)..(378): a, c, t, g, unknown or other
  modified_base (406)..(406): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtggaatattgtgatgactcagtctccactctacctgccccgtcacccctggagagccggcctccatctcctgcaggtccagtcagacgcctcctgcatagaaatgatatactnttgatgantgcagngccaggcagtccccanactcngatctagttgggtactagtcgggcctccggggtacctaagnggttcagtcgnagtgatcgagcacagtatttaccatagaaatcaganagagtcgagntaggagtgttaggttgggttactgtagntagtgacgtatctactaactacgtcgtcgtcggtacgttccggaccgtacggaacgtaaggtaggaacgtaacgtaacgtaaacgtacgtggtacgtaacgtacgaccgtacgtacgtcgttcgttacctcg

SEQ ID NO: 437036 - DNA, 544 bp, Homo sapiens
  misc_feature: GZ8MTXP02JBKUX.13.6.A06.1.454.CMB.2.raw
  modified_base (256)..(256): a, c, t, g, unknown or other
  modified_base (278)..(278): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcaccccgtggagacgccggcctccatcctcctgcaggtccagtcagagcctctgcatagaatgatatactattggattgatngcagagccaggcacgtccccanactctgatctagttgggtactagtccggcctccgggtacctagaggttcaggtgctagtggatcgagcaacgtagtatttacactagaaaatcgagcagagtaggacgtgagaggtagttggtttagggttatacgtgactagtgacagtctactacgacctcgtcgtcggtacgtttcggaccgttagggaacctaaaggtagaacgaacgtaacgaaacgtacgtgtacggaactcgacgtaccacgttcgtcgttacttaccg

SEQ ID NO: 437037 - DNA, 671 bp, Homo sapiens
  misc_feature: GZ8MTXP02HX8M1.13.6.A06.1.454.CMB.2.raw
  modified_base (292)..(292): a, c, t, g, unknown or other
  modified_base (350)..(350): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcaccctggagacgccggcctcatctcctgcaggtccagtcagacgcctcctgctaataagaaatggaataataaactattggattggatctgcagacggcgagggcacgtccccaanaacctccagatctagtttggggttactaacgtccgggtaccgtccgggtaccctaagnggttcaggtgctagtggatcgaggtcactaagttactttaacgaacttagaaaatcgagacgagagtaggagagtggaggtagttagggtttaggggtttaactacgttaggactagtacgtacgtaaacgtacttacctaaaccgtaaccttcgttacggccgggtttaaccgtttcccggggtacccggtttaaacggggaaaacccgttaaaaggggttacgggaaaagtacgttaaaaccggaaaaccgtaacggtttaggtacggtaaccgtacggtaaccaacccgtagttaccttacggtttccgtttaacccg

SEQ ID NO: 437038 - DNA, 511 bp, Homo sapiens
  misc_feature: GZ8MTXP02FEQU6.13.6.A06.1.454.CMB.2.raw
  modified_base (283)..(283): a, c, t, g, unknown or other
  modified_base (397)..(397): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatataactatttggattggtatctgcagaggcagggcagtccccanactcctgatctattggggtctaagcgggccttccggggtccctaagaggttcagtggcagtggatcaggcacagtatttacactagaaaatcagcagagtggagcgtagaggtnttggttgggttattacgtgcatgacagcctataccaactcgtagcgtactttccggcctagggaccaaagtggaacgatacgaaacgtactagtgcgtgacacatctcgtcttc

SEQ ID NO: 437039 - DNA, 558 bp, Homo sapiens
  misc_feature: GZ8MTXP02GV6FK.13.6.A06.1.454.CMB.2.raw
  modified_base (343)..(343): a, c, t, g, unknown or other
  modified_base (385)..(385): a, c, t, g, unknown or other
  modified_base (389)..(389): a, c, t, g, unknown or other
  modified_base (399)..(399): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgccccgtcaccccgtggagagccggcctccatctcctgcaggtccagtcagacgcctcctgcaataagaaatggatataactattgattggtatctgcagaggccagggcacgtaccccacaactcctgatctagttggggttctaagtccgggccgtcccggggtacctaagnggttcaggtgcagtgatcagcacagtatttacactagaaatnaganagagtggagntaggagtgttggttagggtttatacgtgcgtatgacaagtctactaccaactcgtcggtacgttacgttccggaccgtacgggtaaaccgaaaggtaggaacggtaactaacgaaaacgacgtagtacggctacgaccgactactcgttcgttacttcg

SEQ ID NO: 437040 - DNA, 658 bp, Homo sapiens
  misc_feature: GZ8MTXP02H2W43.13.6.A06.1.454.CMB.2.raw
  modified_base (462)..(462): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctcggatccagtgggaatattgtgatgactcagtctccactctacctgccccgtcacccctggagacgccggcctccatctcctgcaggtccagtcagacgcctcctgcaatagaaatggaatataactatttggattggtatctgcagaggccagggcacgtccccaacaacctcctgatactagtttggggttctaagtccggggccttccggggtacccctaacgtagggttcacggtggccaggtcggatcgaggcactagtacttttacatagaaaatcagcagagtggaggctaggaggtagttgggttaggggtttatacgtgtactagtcganaacgtctacgtaacctaaccgtcgttacggacggttaaccgttttccgggacccgttaacggggtaaaccccgtaaaagggttacggaaacggtaaacgttaaaacccgaaaaaccggttaaaacgttcgggttaacgggtaaccgttacggaaaccctaccgtaaccttaccggtttccggtttacctttacccg

SEQ ID NO: 437041 - DNA, 771 bp, Homo sapiens
  misc_feature: GZ8MTXP02I7FL8.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccgtggagacgccggcctccatcctcctgcaggtccagtcagacgccctcctgcaataagaaatggaattataacttagttggattggtatcgtgacagacggaccgagggccaaccgtcccccaacgtaaccttcccgtagaacttacgtttaggtttacggggttactaaacgggttcccggggtacccgttaccccgggggttacccctaaacggtacgggttcaacgggtcggacgtaaggttaggacgtaccggaggcccaaagttaacgttaaactttttaaccaacgttaaggtaaaaactccgaaagtacgaaaggtaagggtagggaacggtacgtaaggtaggggttagtttaggggttttaggggtttaattacgtaggtacgtaagttacggactaaacggtacctacctaaaccgtaaccgttcggtacggtaccggttaaccggtttcccgggaccggtaacgggtaaaaccgtaaagggttaaccggtaagaaaaccggttaacgaaaaacggtaccgtaggggtacgtaaccggacgtaaccgtaaacccttacgttaccgttacgttaccgttaccg

SEQ ID NO: 437042 - DNA, 611 bp, Homo sapiens
  misc_feature: GZ8MTXP02G4OSG.13.6.A06.1.454.CMB.2.raw
  modified_base (400)..(400): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatcctcctgcaggtccagtcagacgcctctgcatagaatggatataactattggattgtatctgcaggaggccaggcacgtccccacaactcctgatcgttagttggggttactaaggtccgggccgtcccggggtcctaagcggttcaggtgctagtggatcgaggcacgtagttactttaacacgttagaaaatcgaganaggtaggtggaggtgtaggtaggtagttgggtttaggggtttattacgtagtctagtacgtagaacgtcttaacctaaccgtaccgtcgtcggtacggtaccgtttaccggacccggttacgggaaccgtaaaaggttgggaacgtaaacgtaaacggtaacgtaaacgtcggtagcgtcgtaccacgttacgtcttacgttactttcccg

SEQ ID NO: 437043 - DNA, 640 bp, Homo sapiens
  misc_feature: GZ8MTXP02J2F08.13.6.A06.1.454.CMB.2.raw
  modified_base (280)..(280): a, c, t, g, unknown or other
  modified_base (308)..(308): a, c, t, g, unknown or other
  modified_base (383)..(383): a, c, t, g, unknown or other
  modified_base (441)..(441): a, c, t, g, unknown or other
  modified_base (479)..(479): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctcgccccgtccaccccgtggagacgcccggcctccatcctcctgcaggtccagtcagacgcctccgtgactaataagaaatggaattataaacttagttggatttggatcgngcaggaggccgagggccacgtccccaanactctagatcgtaggttggtactacgtccgggccgtccgggtacctaagtacggtcgaggcggacaggtaggtanccgacggcactaagttactttacgattaaagaaaactcgagacgagtagggcggaggngtaggaggtacggtttgggtttagggtttacaggttanacgtagtacgactaacgttaccttaacctaaccgtccggttacggtacggttaccgttaccggtaccggaaccggtaagtaaacgtaacggacgaaacgtaaacgaacgaacgtcgtcggtaccgtcgtaaccgacctacgttacttcgtttacgtcctac

SEQ ID NO: 437044 - DNA, 646 bp, Homo sapiens
  misc_feature: GZ8MTXP02GE83X.13.6.A06.1.454.CMB.2.raw
  modified_base (334)..(334): a, c, t, g, unknown or other
  modified_base (375)..(375): a, c, t, g, unknown or other
  modified_base (395)..(395): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggtatctgcagaggccagggcagtccccaacaactcctgatctagttggggttctaagtcgggcctccggggtccctaagnggttcagtggcaggtgatcaggcacagtatttacacgtaanaaatcagcaggagtggaggngtaggaggtagtttgggtttaggggtttaattacgtggactagtacgacgtaacgtaccttaccgtaacctaacccttcgtacgggtaccggttacccggtttacccggggtacccccggttaacggggtaaacccgtaaaagggtacgggtaaacggtaaacttaaaccggtaaaaaccggtaacgttacggggttacggtaaccgtacggaccctaacctacgtttaccgttacgtttaccgtttaccg

SEQ ID NO: 437045 - DNA, 602 bp, Homo sapiens
  misc_feature: GZ8MTXP02GETP4.13.6.A06.1.454.CMB.2.raw
  modified_base (252)..(252): a, c, t, g, unknown or other
  modified_base (276)..(276): a, c, t, g, unknown or other
  modified_base (365)..(365): a, c, t, g, unknown or other
  modified_base (389)..(389): a, c, t, g, unknown or other
  modified_base (395)..(395): a, c, t, g, unknown or other
  modified_base (431)..(431): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatatgtgatgactcagtctccactctacctgcccgtcacccctggagagccggcctccatctcctgcaggtccagtcagacgcctctgcatagaatgatatactattgatgtanctgcagagcagggcacgtccccanaactcctagatctagtttggggttactaagtcggggaccttcccggggtaccaagtacggttcgagtacgcgagtaggatcgaggccanagtatttacactagaaaatcaganagtagnggagcgtagaggtagtggtttgggttactagtagtnaagtggactagactactaccaacgttccgtagccggtacgtttccgggaccgttacgggaaaccgtaaacggtcgggaaagtaaacgttaaacgaaaacggtaaaccgttacggggtacggtaaccgtacgaccgtaaccgtacgtttaccgtttaccgtttaccttaccg

SEQ ID NO: 437046 - DNA, 590 bp, Homo sapiens
  misc_feature: GZ8MTXP02JQ1OB.13.6.A06.1.454.CMB.2.raw
  modified_base (296)..(296): a, c, t, g, unknown or other
  modified_base (362)..(362): a, c, t, g, unknown or other
  modified_base (397)..(397): a, c, t, g, unknown or other
  modified_base (414)..(414): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatcctctgcacggtccagtcaagcgcctcctgcagtaagaatggataataattgttggattggtatcgtgcaggacgccgagggccaccgtccccaanactctgattcgtagttcggggtactacggtccgggtccgtcccgggtacctagtaggttcagtcgnaggtgatcgagcagagttacttacataagaaactnagacgaagagtaggagngtagaggtagttaggttaggttattacgtgatagtagtacaagactaacacgtacgtacggtacgtaacgttacggtttacggaccggtaacggaaaccgtaggaccggtaggtaactaacgtacgtaaacgtacgtaaacgtgtacggtactacggacctacgtactacgtttcg

SEQ ID NO: 437047 - DNA, 616 bp, Homo sapiens
  misc_feature: GZ8MTXP02GPP99.13.6.A06.1.454.CMB.2.raw
  modified_base (288)..(288): a, c, t, g, unknown or other
  modified_base (417)..(417): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtggaatatgtgatgactcagtctccactctacctgccccgtcaccccgtggagacgcccggcctccattcctcctgcaggtccagtcagacgcctctgcatagaaatgatataactattgattggtatctgcagacgccgaggcacgtccccaanactcctgacttctagttgggtctaagtccgggccgtccgggtacctaagtggttcaggtcgcgtaggtcgatcgacgggcaacgtatacgttttacaacgttaagaaaatcaagacaagaggtggaggngtaggaggtagttagggtttagggtttactacgtagtatagttacgacgtaatacctactaacctaaccgttggtcggtaccggttacgtttccgggaccgtaacgggtaaccgtaaaagtaggggtaaacaaacgtaaaccgtaaaacgaaccgttggtacggttcacggacctaacgtcttacgttcctacgtttcc

SEQ ID NO: 437048 - DNA, 649 bp, Homo sapiens
  misc_feature: GZ8MTXP02IOCTB.13.6.A06.1.454.CMB.2.raw
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgccccgtcacccctggagacgccggcctccatctcctgcaggtccagtcagacgcctcctgcaataagaaatggaatataacttattggattggtatcgtgcaggacggccgagggccaccgtccccaacaactcctgtattcgttagtttcggggtactaacggtccgggtcccgtcccggggtacctaacgtaggttcaggtcggctaggtggactcgaaggtcaacgtagttaacttttaaccacgttaagaaaactcagacagtaggtggagcgtagtagggttattagggtttagggtttatacgtgtacgtaagtcggtactaacgtactacccgtaacctaccgttacgtcggtaccggttaccgtttaccggggcccgtaacggggtaaccgtaaaaggttggaaacggttaaacaacggtaaaacgacgttggtacggcttacgacctactactttcgttacgtactttacc

SEQ ID NO: 437049 - DNA, 710 bp, Homo sapiens
  misc_feature: GZ8MTXP02FGMIG.13.6.A06.1.454.CMB.2.raw
  modified_base (225)..(225): a, c, t, g, unknown or other
  modified_base (296)..(296): a, c, t, g, unknown or other
  modified_base (376)..(376): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctcgcccgtcaccccgtggagacgccggcctccatcctcctgcaggtccagtcagacncctctgacatagaatgatataactattgattgtatctgcagacgccagggcacgtccccactactcctgtntcgtagtttcggggttactaacggtcccggggtcccgttacccggggtacccctaaagtacggtttcacgggtggaccgngttacggactcgaggccaacgagttaactttacaacgtagtaaaaactcgaagacgtaaggaaggtcgggacgggacgtaggaagggtagttcgggtaccgggttttagggggttttaacttaacggtacggtactaacgttacgaactaaacggtaccttaacccttaacccgtaaaccctttcggtaccgggtaccggttaaccggttttcccgggaccccgggttaacgggaaacccgtaaagggtacggaaacggtaaccgttaaaaccgaaaaccggtaacgttacggaacggtacgtaccgtacctacctacttcgttctttaacccg

SEQ ID NO: 437050 - DNA, 630 bp, Homo sapiens
  misc_feature: GZ8MTXP02IIR3L.13.6.A06.1.454.CMB.2.raw
  modified_base (250)..(250): a, c, t, g, unknown or other
  modified_base (260)..(260): a, c, t, g, unknown or other
  modified_base (282)..(282): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgccccgtcaccccgtggacgacgcccggcctccatcctcctgcaggtccagtcagacgcctctgcatagaatgatatactnttgattgatntgcagagcaggcacgtacccanactctgactcgtagttcgggtactagtccgggtccgtccggggtacctaagtggtacaggtggactaggtggactacgaggcctaagtagttactttacgaattagaaatcagtacgaggaggtaggaggtgtaggaggtagtttagggtttagggtttatacgtagtactagtacgtaacgtagtaccttacgtacctaaccgttcgtacggtccggtacgtttcccgggaccgttaacgggtaacgtaaagggttacggaaacgtaacgtaaacccgtaaaacggtaccgttggtacggtaaccgtacgacctaacgtacgtttccgttacggttacctttacccg

SEQ ID NO: 437051 - DNA, 582 bp, Homo sapiens
  misc_feature: GZ8MTXP02FHHDQ.13.6.A06.1.454.CMB.2.raw
  modified_base (287)..(287): a, c, t, g, unknown or other
  modified_base (391)..(391): a, c, t, g, unknown or other
  modified_base (401)..(401): a, c, t, g, unknown or other
tcagtcacgtactacacgaccggtgctcgatttagatctactgacagggggaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagagccctctgcatagaaatggataataactatttggattggtatctgcagaggcagggcacgtccccanactcctgatctagttgggttactaagtccggggccgtcccggggtaccaagtaggttcacggtggcaggtggatcgaggcacagtatttaccatagaaatcagnagagtggagngtagagtgttagggtttagggttattacgtgacagtgacaagtactaccgtactaaccgtgtacgtccggtacttccgggacccgtaaggggtaacccgtaaaggtacggaacgaaacgtaacgaaaacgtaacgtacgttcggcgtacggttacaacccgttcttacgtacgttacttac

SEQ ID NO: 437052 - DNA, 526 bp, Homo sapiens
  misc_feature: GZ8MTXP02JFXE0.13.6.A06.1.454.CMB.2.raw
  modified_base (282)..(282): a, c, t, g, unknown or other
  modified_base (331)..(331): a, c, t, g, unknown or other
  modified_base (356)..(356): a, c, t, g, unknown or other
  modified_base (371)..(371): a, c, t, g, unknown or other
  modified_base (376)..(376): a, c, t, g, unknown or other
  modified_base (379)..(379): a, c, t, g, unknown or other
  modified_base (389)..(389): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactattggattggatctgcagaggccagggcagtccccanactcctgatctagttcggggtctaagtcgggccttccggggtcctaacnggttcagtgcagtggatcaggctangtatttacacgtaanaaatnagnagagaggagngtagagtagtggttaggttagtagtagtgtagtgtacgtacgtactactactactcgtcgtcgtacgttcgtcgtacggacgtaagtagacgactacgtaacgacgtacgtcgtcgtcgacactactactcgtactc

SEQ ID NO: 437053 - DNA, 615 bp, Homo sapiens
  misc_feature: GZ8MTXP02IMNA9.13.6.A06.1.454.CMB.2.raw
  modified_base (259)..(259): a, c, t, g, unknown or other
  modified_base (262)..(262): a, c, t, g, unknown or other
  modified_base (265)..(265): a, c, t, g, unknown or other
  modified_base (282)..(282): a, c, t, g, unknown or other
  modified_base (287)..(287): a, c, t, g, unknown or other
  modified_base (343)..(343): a, c, t, g, unknown or other
  modified_base (366)..(366): a, c, t, g, unknown or other
tcagtcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccgtggacgacgccggcctccatcctcctgcaggtccagtcagacgcctcctgacatagaatgatataatagttgtatgatntgnagnggccaggcacgtcccanactcnactcgtagttgggtactagtcggtccgtccgggtactacgtggtcagtgctgtggntcaggctagtgtatttacactanaaatcagtacgaagtggtggagtcgtaggtaggttaagttagggtttaggggtttacttacgtagggtactagttacggtacgtaacgtaccgttaaccgaccttacctacggttacggtaccggtttaacccgttccgggtacccggtaacgggtaaccgtaaagggttagaaacgtaaacgtaaacgtaaaacgtacggttagtcggtaacgtcgacctaccgtttctaccgtttacgtttacctcg

SEQ ID NO: 437054 - DNA, 520 bp, Homo sapiens
  misc_feature: GZ8MTXP01EU4GO.39.8.A08.1.454.CMB.2.raw
  modified_base (196)..(196): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagataccactggagaaatagtgatgtcgcagtctccagccaccctgtctgtgtctccaggggaaangccaccctctcctgcagggccagtcagaatattagcaccaacttagcctggtaaccaacagaaaccctggacccagggtccccagactcctcatctatgatgcatccacaggccactggttcccagccaggttcagtggcagtgggtctggggacaggaagttcaactctcaccatcagcagcctgcagtctgaagtattttgctagtttattactgtacagtacaattatagtaacgtggtgacgttcggacctaaggggaccaaagggtggaaataacgaaacgactgttggctgcacatctgtcttcattccttccgctaa

SEQ ID NO: 437055 - DNA, 546 bp, Homo sapiens
  misc_feature: GZ8MTXP01ER0AG.39.8.A08.1.454.CMB.2.raw
  modified_base (196)..(196): a, c, t, g, unknown or other
  modified_base (248)..(248): a, c, t, g, unknown or other
  modified_base (271)..(271): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagataccactggagaaatagtgatgtcgcagtctccagccacctgtctgtgtctccgaggggaaangccacctctcctgcagggccagtcagaatatagcacaattagcctgaccaanagaactggccaggcccagactcnatctatgatgcatccacgaggcctacgtcggttcccagtccaggttcaggtcgctaggtgggtctggggacagtaacgttcaactctacaccatcagcagcctgcagtcagaatatttgactagtttatactgtacagtactaattagtagtaacgtgggtcgacgttcggaccgtaaagggacctaaagggtacgaaaataacgaaaacggttaacgtggacggtctgaccaccttatccgttagtccttcacttcccgttaaccccgctaacg

SEQ ID NO: 437056 - DNA, 603 bp, Homo sapiens
  misc_feature: GZ8MTXP01EOQ0V.39.8.A08.1.454.CMB.2.raw
  modified_base (263)..(263): a, c, t, g, unknown or other
  modified_base (273)..(273): a, c, t, g, unknown or other
  modified_base (275)..(275): a, c, t, g, unknown or other
  modified_base (291)..(291): a, c, t, g, unknown or other
  modified_base (332)..(332): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcaagaaccnggccacggtncncgcgctacatctactntgtgcactacaccgaccgacgacgtacgtacgtacctaccnctaccccgttacgttgcgtacgtcggtcgggtacggcggacgtagtacgtctactaccactactacacgacgacgtacgtcgtacgtacgtacgtacgtagttagttcgttcgtacttagtttacgttacgtacgtaacgtaacgtaacgtaacgtacgtacgtacgtccgtcctaccttccgttcggtcgggtacgggacgggtacgggttagggtaggtacgaacgaacgaacgtaacggtggtcgtcgtacgacctaaccgttcgtcg

SEQ ID NO: 437057 - DNA, 503 bp, Homo sapiens
  misc_feature: GZ8MTXP01C1JY4.39.8.A08.1.454.CMB.2.raw
  modified_base (323)..(323): a, c, t, g, unknown or other
  modified_base (350)..(350): a, c, t, g, unknown or other
  modified_base (493)..(493): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccacagggccactggtatcccaaacnggttcagtggcagtgggtctggggacngaattcaactctcaccatcagcagcctgcagtctgaagtactttggagtttataactgtacaaacagtacaatgaactggcctctctacgtttcggcggtagggaaccaaggttggagatacgaagacgttgttggctgcacnttctgttctc

SEQ ID NO: 437058 - DNA, 522 bp, Homo sapiens
  misc_feature: GZ8MTXP01D4CUI.39.8.A08.1.454.CMB.2.raw
  modified_base (332)..(332): a, c, t, g, unknown or other
  modified_base (353)..(353): a, c, t, g, unknown or other
  modified_base (393)..(393): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccacagggcccatggtactcccagcccactttagnggcaggtgggtctaggggacngagttcactctcacataacgcagcctgcagtctagaagtntttgcttagtttattactgtacaaactagtaacaagtgactggcctctctacgtttcgggcggagggaaccaagggttggagagtacgaaacgttacgttgttagggctaggcacgattctgttcttcc

SEQ ID NO: 437059 - DNA, 525 bp, Homo sapiens
  misc_feature: GZ8MTXP01D1303.39.8.A08.1.454.CMB.2.raw
  modified_base (293)..(293): a, c, t, g, unknown or other
  modified_base (332)..(332): a, c, t, g, unknown or other
  modified_base (350)..(350): a, c, t, g, unknown or other
  modified_base (377)..(377): a, c, t, g, unknown or other
  modified_base (391)..(391): a, c, t, g, unknown or other
  modified_base (503)..(503): a, c, t, g, unknown or other
tcagtcgcactagtcacgaccggtgctcgatttagcatactctacagggggaggaactgctcagttaggacccagacggaaccatggaagcccagcgcagcttctcttcctcctgctactctggctccagatatcactggagaaatagtgatgacgcagtctccagccaccctatctgtgtctccaggagaaagagccaacctctcctgtagggccagtcagagtgtagcagcaacttagcctggtaccagcaagaaacctggaccaggttcccaggctcatcatctatggtncatccacgaggcccagtggtactcccagcctactttagnggcaggtggtctgggacngagttcactctcaccatcagcagcctncagtctagaagttnttgacttagtttattactaggtaacaaagtaagtaacaatcgacgtcgtccttctcgtacgttcgggacggaagggacgaagggtgaagtaacgtaacgaaacgttgttggngtctcgcacgttctcgttgtcc

SEQ ID NO: 437060 - DNA, 517 bp, Homo sapiens
  misc_feature: GZ8MTXP01D0KYL.39.8.A08.1.454.CMB.2.raw
  modified_base (336)..(336): a, c, t, g, unknown or other
  modified_base (357)..(357): a, c, t, g, unknown or other
  modified_base (396)..(396): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttgcctggtaccagcagaaacctggccaggttcccaggctcatcatctatggtgcatccaccgagggccacgtggtactccccagcctacctttagnggcaggtgggtctaggggacngagttcactctcacatcagcagcctgcagtctagaagtntttgctagtttattactgtacaactagtacaatgactcggccttctctacgtttcgggcgggtaagggaccgaagggtggagagtacaaacgcttggtggctcggcacattcgttgtttcc

SEQ ID NO: 437061 - DNA, 604 bp, Homo sapiens
  misc_feature: GZ8MTXP01D9N5G.39.8.A08.1.454.CMB.2.raw
  modified_base (196)..(196): a, c, t, g, unknown or other
  modified_base (260)..(260): a, c, t, g, unknown or other
  modified_base (292)..(292): a, c, t, g, unknown or other
  modified_base (375)..(375): a, c, t, g, unknown or other
tcagtcgcactagtcacgaccggtgctcgatttagcatactctacagggggaggaactgctcagttaggacccagacggaaccatggaagcccagcgcagcttctcttcctcctgctactctggctcccagatatcactggagaaatagtgatgacgcagtctccagccaccctatctgtgtctccaggagaaagngccacctctcctgtagggccagtcagagtgttagcagcaacttgcctggtaccagcaagaaccnggccaggttcccaggctcatcatctagtggtncactccaccgagggccctacgtcggtactccccagtccctaaccgttttaggcgggcgtagggtcggggtcgtagggggaacnggtacgttccacctctaccaccatcacgcacgcctgcagttactagtaagttatttgacttaaactttattacctaggttaactaaacttaattttaacttcttaactcccgtcttaccgtacggtttccggggacgggtaacggggaaccgtaaagggtggaagtaacgttaacgaaaacgtacgttggttcggactgacctaacctattcttcgttccttcgtaacc

SEQ ID NO: 437062 - DNA, 524 bp, Homo sapiens
  misc_feature: GZ8MTXP01CCBHV.39.8.A08.1.454.CMB.2.raw
  modified_base (197)..(197): a, c, t, g, unknown or other
  modified_base (335)..(335): a, c, t, g, unknown or other
  modified_base (354)..(354): a, c, t, g, unknown or other
  modified_base (395)..(395): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggttcccaggctcgatcatctatggtgcatccaccagggccactggtactcccagcctacctttagnggcaggtgggtctgggacngagttcactctcaccatcagcagcctgcagtctagtaagtntttgctagtttattactggtcaaacgagtacaaatcgactcggcctcgtcctacgtttccgggcggaacgggaccgaaggggtggacgtaagtcaaaacggacttggtcgactgcacttatcttgttcc

SEQ ID NO: 437063 - DNA, 511 bp, Homo sapiens
  misc_feature: GZ8MTXP01D1P3G.39.8.A08.1.454.CMB.2.raw
  modified_base (264)..(264): a, c, t, g, unknown or other
  modified_base (295)..(295): a, c, t, g, unknown or other
  modified_base (337)..(337): a, c, t, g, unknown or other
  modified_base (404)..(404): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcaagaaaccnggccaggttcccaggctcatcatctatggtncatccacgagggccacgtggtactcccagcctaccgtttagnggctaggtgggtctaggggacaaggtacgttccactctcaccatcagcagcctgcagtctagaagtntttgactagtttattactgtacaatagtacatgactggcctctctacgttcggcggaagggacaaggggtgaagatacaaacgcttggtgctgccacatcgttgttc

SEQ ID NO: 437064 - DNA, 531 bp, Homo sapiens
  misc_feature: GZ8MTXP01D5M71.39.8.A08.1.454.CMB.2.raw
  modified_base (263)..(263): a, c, t, g, unknown or other
  modified_base (278)..(278): a, c, t, g, unknown or other
  modified_base (290)..(290): a, c, t, g, unknown or other
  modified_base (318)..(318): a, c, t, g, unknown or other
  modified_base (331)..(331): a, c, t, g, unknown or other
  modified_base (334)..(334): a, c, t, g, unknown or other
  modified_base (352)..(352): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaaccnggcaggtccaggctnatcatcatggtncacaccacgacggccacgtgtactccancctactttacggnggngtaggtggtcgtagggangtagtcactctcacatcagcacgctgcagtacgtagtaagtattgtatagtttattacttagtactaaacaataactaatagtacgtcgtcctctctacgttcggtcgggaacgggaacggaaggtaggaagaacgtaacgaaacgaacgttagtggtcgtcgacacactcgttcgttc

SEQ ID NO: 437065 - DNA, 537 bp, Homo sapiens
  misc_feature: GZ8MTXP01EJJ3S.39.8.A08.1.454.CMB.2.raw
  modified_base (262)..(262): a, c, t, g, unknown or other
  modified_base (339)..(339): a, c, t, g, unknown or other
  modified_base (359)..(359): a, c, t, g, unknown or other
tcagtcgcactagtcacgaccggtgctcgatttagcatactctacagggggaggaatgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcaagaaccnggccaggttcccaggctcatcatctatggtgcatcccaccgagggcccacgtcggtactcccagccctacgtttagnggcaggtgggtctggggacngtagttcactctcacatcagcagcctgcagtctgtaagtatttgacttagtttattacttggtactaaagtagtacagtgactcggaccttcgtctacgtttcgggcgggaacgggaccgaagggtcggaagacgtaacgaaacggttacgttggtgctcgacacttatccttgttcc

SEQ ID NO: 437066 - DNA, 540 bp, Homo sapiens
  misc_feature: GZ8MTXP01EJVN1.39.8.A08.1.454.CMB.2.raw
  modified_base (265)..(265): a, c, t, g, unknown or other
  modified_base (296)..(296): a, c, t, g, unknown or other
  modified_base (337)..(337): a, c, t, g, unknown or other
  modified_base (358)..(358): a, c, t, g, unknown or other
  modified_base (399)..(399): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagccctggtaccagcaagaaaccnggccaggttcccaggctcatcatctatggtncatccacgagggcccagtggtactcccagccctactttagnggcaggtgggtctaggggacnggtattcactctcacatccagcagctgcagtctagtaagtntttgctagtttattactggtactaactagtaacatgtactggcctctctacgtttcgggcgggtaacgggacgaagggtggaagtacgtaacgaaacggttacgttggtaaggcgtcggccaccttacttcttcgttaacc

SEQ ID NO: 437067 - DNA, 492 bp, Homo sapiens
  misc_feature: GZ8MTXP01ADZBO.39.8.A08.1.454.CMB.2.raw
  modified_base (351)..(351): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatcccagccacctttagtggcagtgggtctggggacngagttcactctcacatcagcagcctgcagtctgaagtattttgctagtttattactggtcaacagtacaatgactggcctctcacttcggcggaagggaccgaaggtggagatcaaacgacttgtggctgcacatcttgtc

SEQ ID NO: 437068 - DNA, 646 bp, Homo sapiens
  misc_feature: GZ8MTXP01DZDF3.39.8.A08.1.454.CMB.2.raw
  modified_base (304)..(304): a, c, t, g, unknown or other
  modified_base (374)..(374): a, c, t, g, unknown or other
  modified_base (393)..(393): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagcccaccctctcctggtacggccagtcagagtgttagcagctaacgttacgcctggtaaccagcaacgaaacctggccaggttcccaggctcatcatctatggtgcntcccaccgaggggcccacgtggtactcccagccctacctttaggcggctagggtcggtcgtaggggaacnggtcgtcactctccaaccntacacgacacgtccgtgacagttccgtagtaactagttttcggacttaagttttacttaacgttaggttacctaaacgtacggttaactaacgttcgtaacgtttcggtaccctttcgtaccgttaacggtttccgggacgggtaacgggtaaccggttaaagggtagggttaacgaacgtaaccgttaaaacggttaaccgttggtaacggtcgttaacggacccgtaccgttattcccgttgtttaacccg

SEQ ID NO: 437069 - DNA, 522 bp, Homo sapiens
  misc_feature: GZ8MTXP01EE36D.39.8.A08.1.454.CMB.2.raw
  modified_base (336)..(336): a, c, t, g, unknown or other
  modified_base (356)..(356): a, c, t, g, unknown or other
  modified_base (398)..(398): a, c, t, g, unknown or other
  modified_base (443)..(443): a, c, t, g, unknown or other
  modified_base (512)..(512): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctctcctgtagggccagtcagagtgttagcagcaacttagcctggtaccagcagaaacctggccaggttcccaggctcatcatctatggtgcatccacagggcccacgtggtactcccagcctaccgtttagnggcaggtgggtctggggacnggagttcactctcaccatccagcagcctgcagtctagtaatntttgctagtttatactggtacaaactagtacaatgactggacctntcacgttcggcggaagggaccaaggggtgaagtactacgaaaacgttcgttggtcgctggccaaccttntcgttcgttc

SEQ ID NO: 437070 - DNA, 547 bp, Homo sapiens
  misc_feature: GZ8MTXP01CN7WX.39.8.A08.1.454.CMB.2.raw
  modified_base (263)..(263): a, c, t, g, unknown or other
  modified_base (338)..(338): a, c, t, g, unknown or other
  modified_base (359)..(359): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaaccnggccaggttcccaggctcatcatctatggtgcactccacgagggccacgtggtactcccagccctacgtttacgnggcaggtgggtctaggggacnggtagttcacttctcaccatcagcacgcctgctagtctagaagtattttgcttagtttattacgttggtacaacgtagtacaagtcgacgtggctcgtctacgttcgggcggtaagggaaccgttagggtcggagtaagtacgaaacggcttgggtaaggacttggacgacccttagttccttgttcc

SEQ ID NO: 437071 - DNA, 585 bp, Homo sapiens
  misc_feature: GZ8MTXP01ALTDO.39.8.A08.1.454.CMB.2.raw
  modified_base (197)..(197): a, c, t, g, unknown or other
  modified_base (263)..(263): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccaccctctcctgtagggccagtcagagtgtagcagcaacttagcctggtaccagcagaaaccnggccaggttcccaggctcatcatctagtggtgcactcccaccgagggcccagtcggtactccccgagccctaaccgttttaggcgggctagggtcggggtctagggggacctaaggtacgttccactctaccaccatcagcacgtcctgcagtctagtaagtgtttgacttagtttacttactggtacaagtagtaactaatgacgtcggcctctcgtacgtttcgggcgggtaacgggaaccgagggtggaagtaacgtaacgaaaacggttcgttacgggtcgggactcggaccctaccgttacttccgttcgttaaccc

SEQ ID NO: 437072 - DNA, 554 bp, Homo sapiens
  misc_feature: GZ8MTXP01DU63N.39.8.A08.1.454.CMB.2.raw
  modified_base (294)..(294): a, c, t, g, unknown or other
  modified_base (333)..(333): a, c, t, g, unknown or other
  modified_base (354)..(354): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgtagcagcaacttagcctggtaccagcagaaacctggccaggttcccaggctcatcatctatggtncatccacgaggccagtggtactcccagcctactttaggnggcgaggtgggtctagggacnggtgttcacttctcacatcagcacgctgcagttcgtagtaagttatttgacttagtttattacgtaggtactaaacgtagtaacaatcgtacgtggtcctctcgtacgttcgggcgggtaagggaaccgaaggggtggagtaacgtaacgaaaacgttacgttggtcggcgttcggcctaccgttacttccgttcgttcc

SEQ ID NO: 437073 - DNA, 532 bp, Homo sapiens
  misc_feature: GZ8MTXP01D7X2Y.39.8.A08.1.454.CMB.2.raw
  modified_base (294)..(294): a, c, t, g, unknown or other
  modified_base (356)..(356): a, c, t, g, unknown or other
  modified_base (398)..(398): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtncatccacgagggcccagtggtactcccagcctacctttagcggcaggtgggtctaggggacnggtacgttcactctcacatcagcagcctgcagtctagaagtntttgctagtttattactggtacaactagtacaatcgacgtcggtacctctcgtacgtttcgggcgggtaacgggacgttaagggtcggagatacgaaacgttacgttggtgggctggcaccttgtcttcgttcc

SEQ ID NO: 437074 - DNA, 523 bp, Homo sapiens
  misc_feature: GZ8MTXP01A6V8I.39.8.A08.1.454.CMB.2.raw
  modified_base (263)..(263): a, c, t, g, unknown or other
  modified_base (338)..(338): a, c, t, g, unknown or other
  modified_base (357)..(357): a, c, t, g, unknown or other
  modified_base (398)..(398): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaaccnggccaggttcccaggctcatcatctatggtgcatccaccgagggcccacgtggtactcccagccctacctttagnggcaggtgggtctgggacngagttcactctcaccatcagcagcctgcagtctagtaagtntttgacttagtttatactggtacaactagtacaatgactggacctctctacgtttcgggcgggaaggaccgaaggggtggaagtagtacgaaacggttcttggtgggctgctacatcttggttcc

SEQ ID NO: 437075 - DNA, 549 bp, Homo sapiens
  misc_feature: GZ8MTXP01BI1YE.39.8.A08.1.454.CMB.2.raw
  modified_base (197)..(197): a, c, t, g, unknown or other
  modified_base (292)..(292): a, c, t, g, unknown or other
  modified_base (342)..(342): a, c, t, g, unknown or other
tcagtcgcactagtcacgaccggtgctcgatttagcatactctacagggggaggaactgctcagttaggacccagacggaaccatggaagccccagcgcagcttctcttcctgctgctactctggctcccagatatcactggagaaatagtgatgacgcagtctccagccaccctatctgtgtctccaggagaaagngccaccctctcctgtagggccagtcagagtgtagcagcaacttagcctggtaccagcagaacctggccaggtcccaggctcatcatctagtggtncatcccaccgagggcccacgtggtactcccgagtccctacccgtttaggnggcgaggtcggggtactggggaacaggtacgttccactctcaccctatcagcacgcctgcagtcgtagtaagtatttgcttagtttacttacgtgtacaactagtaacagtgacgtcgcctcgtctacgttcgggcggtagggaccgaagggttgaagattacgaaacgttacgtggtacggtctcggaccttacctaagttcgtcg

SEQ ID NO: 437076 - DNA, 543 bp, Homo sapiens
  misc_feature: GZ8MTXP01ADU2N.39.8.A08.1.454.CMB.2.raw
  modified_base (197)..(197): a, c, t, g, unknown or other
  modified_base (337)..(337): a, c, t, g, unknown or other
  modified_base (405)..(405): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccacctctcctgtagggccagtcagagtgtagcagcaacttagcctggtaccagcagaaacctggccaggttcccaggctcatcatctatggtgcatcccgacgagggccacgtggtactcccagccctactttaggnggctaggtcgggtctaggggactaagtacgttccacttctcaccatcagcagctgcagtctagaagtntttgacttaagtttactactggtacaactagtaacaatgactcggtacctctccgtacgttcgggcgggaacgggacgagggtggagacgttaacgaaacgttacgttggtcggctcggccacttattcgttgttccc

SEQ ID NO: 437077 - DNA, 658 bp, Homo sapiens
  misc_feature: GZ8MTXP01BV8V3.39.8.A08.1.454.CMB.2.raw
  modified_base (298)..(298): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccacctatctgtgtctccaggagaaagcgcccacctctcctggtacgggccagtcagagtgttagcagctaacttagcctggtaccagcaagaacctggccaggttcccaggctcatcatctagtggtncactccaccgagggcccagtggtactccccgagccctaaccgtttaggcggactagggtcgggtcgtaaggggaacctggtacgtttccaaccttctaccaaccctagtcccgagccacggtccctggacctaaggttccgtaaggtaagttgttttcggactttaagttttaattaccgtagtaacaaacgtagtaactaagtcgtacgtggtacccttgtaccgtacggtttccgggacggggtaacgggtaacccgttaagggggttacggaagtaaaccgtaaccgttaaaacgggttcgttacgggttcgggaccttaacggacccgtaaccttacgtttccgtttcgtttcccc

SEQ ID NO: 437078 - DNA, 514 bp, Homo sapiens
  misc_feature: GZ8MTXP01DKU6J.39.8.A08.1.454.CMB.2.raw
  modified_base (358)..(358): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgtagcagcaacttagcctggtaccagcaagaaacctggccaggttcccaggctcatcatctatggtgcatccacgagggcccacgtggtactcccagcctaccgtttagcggcaggtgggtctaggggacnggtagttcactctacacatcagcacgcctgcagtctagaatatttgatagtttattactggtacaactagtacatgactggtacctctctacgttcgggcggaagggacagggtgagtatacaaacgcttggtggctcgccacacgttcttgttcc

SEQ ID NO: 437079 - DNA, 622 bp, Homo sapiens
  misc_feature: GZ8MTXP01CNF2N.39.8.A08.1.454.CMB.2.raw
  modified_base (270)..(270): a, c, t, g, unknown or other
  modified_base (301)..(301): a, c, t, g, unknown or other
  modified_base (443)..(443): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggaagaaatagtgatgacgcagtctccagccacctatctgtgtctccgaaggaagaaagacgcccaccctctcctggtagggccagtcaggagtgtagcagcaacttagcctaggtaccagcaagaaccnggccaggtcccaggctcatcatctagtggtncactccaccgagggcccaacgtcggtactccccgagacccctaacgttttaggcggacgtagggtggggtaccgtaaggggaacctaaggtacgtttccaaccttccacaacctaatcaagcaacggccctagccgtagttntaggaagttattttgacttaagtttatacgttggtacaaacgtataacagtgacgtcggacctctccgtaacggtttcgggacggaacgggtaaccgaaggggtacggataaacgtaacgaaaaccggttacgttgggtggccttaacgggccctaacttacgttccttcgggtttccc

SEQ ID NO: 437080 - DNA, 714 bp, Homo sapiens
  misc_feature: GZ8MTXP01A8PY7.39.8.A08.1.454.CMB.2.raw
  modified_base (197)..(197): a, c, t, g, unknown or other
  modified_base (292)..(292): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccacctctcctgtagggccagtcagagtgtagcagcaacttagcctggtaccagcagaacctggccaggttcccaggctcatcatctagtggngcactcccaccgagggcccagtcggtacctccccgagtcccctaccgttttacggcgggacgtagggttcgggggtcctagggggaacctaaggtacgtttcccaacttcctaccaacccgtatacgacgacacgtccgtacgtaccgtaggttccgtaggtaaagttacgttttacggaccgtttaagttttaactttaaccgttacggggttaacctaaaccgttaacgttaaaccgtaaacgttacggtaaccgttccgggttaccccttccgttacccgttaacccggttttaccggggaccggggtaaaccggggtaacccggaaaggggttacggaacgtaaacgttaaccgaaaacggttacgttacgggtaaggtcgtaacggaccgtaccttacgttccgttcgtttaacccg

SEQ ID NO: 437081 - DNA, 649 bp, Homo sapiens
  misc_feature: GZ8MTXP01CD3GO.39.8.A08.1.454.CMB.2.raw
  modified_base (200)..(200): a, c, t, g, unknown or other
  modified_base (290)..(290): a, c, t, g, unknown or other
  modified_base (297)..(297): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggcctcccagattccactggagaaatagtgatgacgcagtctccagcccaccctgtctgtgtctccgaggggaaangtccacccctctcctgcagggccagtcagagtgtagcagcaacttgcctggaccagcaagaaacctggaccaggcctcccgaggcctccncatctangatcgccctccaccgagggccacgtggtacctcccaggtcctaggttcaggtcggacgtaagtgggtcgtaggggaactgacgtttcacgttctacgtattactacagcacggtccgtggacctaggttaccgtaaggtaaagtagttttaacgacgtttaacttttagttacccttaggggtactaaggactaaggtaattaagtggtaacgtcggtacccgttacgggtaccggaccgtaaaggggtaaccgtaaagggttacgggtaaaacttaccgtaaaaacgggtcttacgggttcggccttaacggacccgtaactattccgttacgtttccgttcttaaccccg

SEQ ID NO: 437082 - DNA, 595 bp, Homo sapiens
  misc_feature: GZ8MTXP01DYTT0.39.8.A08.1.454.CMB.2.raw
  modified_base (198)..(198): a, c, t, g, unknown or other
  modified_base (264)..(264): a, c, t, g, unknown or other
  modified_base (296)..(296): a, c, t, g, unknown or other
  modified_base (364)..(364): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttgcctggtaccagcaagaaaccnggccaggttcccaggctcatcatctagtggtncactccaccgaggcccagtcggtactcccagcctaccgtttagcggctaggtcgggtcgtaggggacnggtacttcacgtctacacatcagcacgtctgctagtcgtagtaagttctttgacttagttttaattaccgttaggttacaaactagttaactaagtcgacgttcggtaccttcgtaccgtacggtttccgggacgggtaaacgggtaccgaaggggttaggaacgtaaacgtaaccgaaaacggttcgttggtcggtacttcggaccctacgttattccgttaagtttccc

SEQ ID NO: 437083 - DNA, 594 bp, Homo sapiens
  misc_feature: GZ8MTXP01DRC41.39.8.A08.1.454.CMB.2.raw
  modified_base (196)..(196): a, c, t, g, unknown or other
  modified_base (424)..(424): a, c, t, g, unknown or other
  modified_base (509)..(509): a, c, t, g, unknown or other
  modified_base (585)..(585): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaatagtgatgacgcagtctccagccaccctatctgtgtctcaggagaaagngccacctctcctgtagggccagtcagagtgtagcagcaacttcgctggtaccagcaagaaacctggaccaggttcccaggctcatcatctagtcggtgccactcccacgaggccctagtcggtactcccacgtccctaaccgtttggcgggactaggggttcggggtcgtaagggggaactaaggtctttaccaccttcctaaccacctataccgagcacgttcccgngaccgagggacttaggaagtgtggtacggcttaaagttttacctaggttctaactaacttaaatttataactacgtccttacctntaacgttcgttgggcccgaagggtacaaggtcagggtaacacttaacgaaacggttagtgtacggctgaccacgtnttcgttaac

SEQ ID NO: 437084 - DNA, 620 bp, Homo sapiens
  misc_feature: GZ8MTXP01DDW8L.39.8.A08.1.454.CMB.2.raw
  modified_base (210)..(210): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggcctcccagatatcactggagaaatagtgatgacgcagtctccagccaccctatctgtgtctccgaggagaaagcgcccaccctntccgtggtagggccagtcagagtgtagcagctaacttgcctggtaccagcaagaacctggccaggttcccaggctcatcatctagtggtgcactcccaccgagggtccctaagtcgggttaactcccccgagtccctaaccgttttaggcgggtactagggttcgggggtaccgtaagggggaaacctaagggtacgtttccaaccttcctaccaacctagtccacgcacgtcctgactaggtctagtagttatttgacttagtttacttacgtggtacaaactaagtactaagtcgtacgtcggtaccttctctacggttcgggacgggtaacgggtaaccgaagggtgaagtaacgtaacgaaaacgttacttgggtcggtctaacgctaccttattccgttcgttcc

SEQ ID NO: 437085 - DNA, 572 bp, Homo sapiens
  misc_feature: GZ8MTXP01D7A62.39.8.A08.1.454.CMB.2.raw
  modified_base (198)..(198): a, c, t, g, unknown or other
  modified_base (207)..(207): a, c, t, g, unknown or other
  modified_base (226)..(226): a, c, t, g, unknown or other
  modified_base (264)..(264): a, c, t, g, unknown or other
  modified_base (294)..(294): a, c, t, g, unknown or other
  modified_base (372)..(372): a, c, t, g, unknown or other
  modified_base (386)..(386): a, c, t, g, unknown or other
  modified_base (545)..(545): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggcctcccagatatcactggagaaatagtgatgacgcagtctccagccaccctatctgtgtctccaggagaaagngccaccctntcctgtagggccagtcagngtgtagcagcaacttagcctggtaccagcaagaaaccnggccaggttccaggctcatcatctatggtncacctaccacggcgacctagtacgtccaccgacgtaccttacgttcggcgagtgggtcgtggaacgacgtgtactacnctcaccactctacncacgacgtcgacgactagtacgtaagtagtttgtcgagtttaatttacttgttacggtaacaacgtaactaactagtcgtacgcgttacctcgtacgttacggtcggaggggaacgtacggttagggagttaagacgtaaacgaacgttcggttcggtntcggtcacctacttattcgttcttccg

SEQ ID NO: 437086 - DNA, 506 bp, Homo sapiens
  misc_feature: GZ8MTXP01BQK9S.39.8.A08.1.454.CMB.2.raw
  modified_base (197)..(197): a, c, t, g, unknown or other
  modified_base (294)..(294): a, c, t, g, unknown or other
  modified_base (352)..(352): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagctacaacttagccctggtaccagcagaaacctggccaggtcccaggctcatcatctatggtncatccacagggccactggtactcccagccactttagcggcagtgggtctgggaacagngttcactctcaccatcagcagcctgcagtctagaagtatttgctagtttattactgtacaactagtacaatgactggcctcgtctacgtttcggcggagggaaccaagggttggagatacgaaagacgttgttaggctgcacattctgttcttc

SEQ ID NO: 437087 - DNA, 531 bp, Homo sapiens
  misc_feature: GZ8MTXP01D2LWS.39.8.A08.1.454.CMB.2.raw
  modified_base (197)..(197): a, c, t, g, unknown or other
  modified_base (292)..(292): a, c, t, g, unknown or other
  modified_base (401)..(401): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttgcctggtaccagcagaacctggccaggttcccaggctcatcatctatggtncatccacgagggcccagtggtactccccagcctaccgtttagcggctaggtcgggtctaggggactggtagttccactctcacatcagcagcctgcagtctagtaagtntttgacttagtttatactggtacaacgtagtacaagtgacgtcggccttctcgtacgttcgggcgggaacgggtacgaaggggtgaagagtaacgaaacgttcttggtgcgtcgctacattcgttgttcc

SEQ ID NO: 437088 - DNA, 529 bp, Homo sapiens
  misc_feature: GZ8MTXP01EOP42.39.8.A08.1.454.CMB.2.raw
  modified_base (197)..(197): a, c, t, g, unknown or other
  modified_base (261)..(261): a, c, t, g, unknown or other
  modified_base (291)..(291): a, c, t, g, unknown or other
  modified_base (335)..(335): a, c, t, g, unknown or other
  modified_base (355)..(355): a, c, t, g, unknown or other
  modified_base (358)..(358): a, c, t, g, unknown or other
  modified_base (398)..(398): a, c, t, g, unknown or other
  modified_base (455)..(455): a, c, t, g, unknown or other
  modified_base (495)..(495): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgtagcagctaacttgcctggtaccagcagaaccnggccaggttcccagctcatcatctatggtncatccaccagggcccacgtggtactcccgagccctactttacgnggcaggtgggtctagggacnggngttcacttctccacatcacgcacgcctgcagtctagaatntttgcttagtttatactggtacaactagtacatgactcggtctcgtctacgttcggngggtaacggaccgttaggtcgagtacgtacgaacgttagngttggacttggaccacgacttcgttaacgttccc

SEQ ID NO: 437089 - DNA, 657 bp, Homo sapiens
  misc_feature: GZ8MTXP01CRR4L.39.8.A08.1.454.CMB.2.raw
  modified_base (264)..(264): a, c, t, g, unknown or other
  modified_base (296)..(296): a, c, t, g, unknown or other
  modified_base (340)..(340): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctccagatatcactggagaaatagtgatgacgcagtctccagccaccctatctgtgtctccgaggagaaagcgcccaccctctccgtgtaggccagtcagagtgtagcagctaacttagcctggtaccagcaagaaccnggccaggttcccaggctcatcatctagtggtncactccgaccgaggcccagtgtactcccgagccctacgtttagnggtctagggtcgggtctaaggggaactggtactttccacttccaccaacctatccacgcacgcctaggcctaggttcgtagtaagttagttttacgacgtttaagtttacttaaccgttagggttaacctaaacgttaacggtaactaaagttccggtaaccgttcggtaaccccttcgttaccgtaaccgggtttccggggaaccggggtaacgggtaaccgttaagggggtacggaacgtaacgttaaccggaaaacggttcgttacggtaacgggaccttcggaccctacttacgtttccggttcgtttaaccc

SEQ ID NO: 437090 - DNA, 564 bp, Homo sapiens
  misc_feature: GZ8MTXP01DU2EA.39.8.A08.1.454.CMB.2.raw
  modified_base (195)..(195): a, c, t, g, unknown or other
  modified_base (204)..(204): a, c, t, g, unknown or other
  modified_base (456)..(456): a, c, t, g, unknown or other
tcagtcgcactagtcacgaccggtgctcgatttagcatactctacagggggaggaactgctcagttaggacccagacggaaccatggaagcccagcgcagcttctcttcctcctgctactctggctcccagatatcactggagaaatagtgatgacgcagtctccagccaccctatctgtgtctcaggagaaagngccaccctntcctgtacgggccagtcagagtgttagcagctaacttgcctggtaccagcaagaaaccgtggaccaggttcccaggctcatcatctagtggtgctatccgaccgagggcccagtcggtactcccagtcctacctttaggcggctaggtcgggtcgtagggactggtagttccacttcgtacacgtatcgagcacggtctgctagtcgttagtaatagtttcgacttagtttattacgtgggtacaatagtanaagtgtactggtcctactcgtaacgttcgggacggtaaggtccgaagggtcgaagcgtaacaaaacggttgttaggtcggactcggctacgttattcgttaagtttcc

SEQ ID NO: 437091 - DNA, 515 bp, Homo sapiens
  misc_feature: GZ8MTXP01BPM34.39.8.A08.1.454.CMB.2.raw
  modified_base (292)..(292): a, c, t, g, unknown or other
  modified_base (301)..(301): a, c, t, g, unknown or other
  modified_base (357)..(357): a, c, t, g, unknown or other
  modified_base (444)..(444): a, c, t, g, unknown or other
  modified_base (492)..(492): a, c, t, g, unknown or other
  modified_base (510)..(510): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagcccaccctctcctgtagggccagtcagagtgtagcagcaacttgcctggtaccagcagaacctggccaggttcccaggctcatcatctatggtncatccacgngggcccacgtggtactcccagccctacgtttagcggcaggtcgggtctaggggacngtcgttcactctcaccatcagcagcctgcagtctagtaagtatttgactagtttatactggtacaacagtacaatcgactggtcctntcctacgtttcgggcggaagggtaccaagggtggagacgtacaaacgnttgtggctgcacattcgngttcc

SEQ ID NO: 437092 - DNA, 526 bp, Homo sapiens
  misc_feature: GZ8MTXP01A3KG9.39.8.A08.1.454.CMB.2.raw
  modified_base (197)..(197): a, c, t, g, unknown or other
  modified_base (266)..(266): a, c, t, g, unknown or other
  modified_base (361)..(361): a, c, t, g, unknown or other
  modified_base (376)..(376): a, c, t, g, unknown or other
  modified_base (496)..(496): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccaccctctccgtgtacgggccagtcagagtgttagcagcaacttagcctggtaccagcagaaaccnggccaggttcccaggctcatcatctatggtgcactccaccgagggcccactggtactcccagcctacctttagcggcgaggtgggtctagggacngagttcactctcacntcagcagctgcagtctagtagtattttggtatttatatgtactatagtacatgacgtgtctctcgtcgtttcggcgggagggaacgaagggttggaagataacgaaacggttacgttggnggaacctgaacctcgattctgttccttaac

SEQ ID NO: 437093 - DNA, 568 bp, Homo sapiens
  misc_feature: GZ8MTXP01A1UCV.39.8.A08.1.454.CMB.2.raw
  modified_base (197)..(197): a, c, t, g, unknown or other
  modified_base (262)..(262): a, c, t, g, unknown or other
  modified_base (293)..(293): a, c, t, g, unknown or other
  modified_base (349)..(349): a, c, t, g, unknown or other
  modified_base (373)..(373): a, c, t, g, unknown or other
  modified_base (387)..(387): a, c, t, g, unknown or other
  modified_base (491)..(491): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccacctctcctggtagggccagtcagagtgtagcagcaacttagcctggtaccagcagaaccnggccaggttcccaggctcatcatctatggtncactcccaccgagggggcccaacgtcggtactccccgaaggccctaaccgttttgngggacagggtgggtctaggggacngtacgttcacttcncacatcagcacgctgcagtctagtaagtatttgcttagtttattactgtacctaatagtaacaagttcgaacgtcgggtccctacgtccgtacgtttccggggngggtaacgggaccgaagggtggaggtactaacgaaacgttacgttggtaacggctggacctacttacttcgttcgtc

SEQ ID NO: 437094 - DNA, 518 bp, Homo sapiens
  misc_feature: GZ8MTXP01D0K97.39.8.A08.1.454.CMB.2.raw
  modified_base (197)..(197): a, c, t, g, unknown or other
  modified_base (292)..(292): a, c, t, g, unknown or other
  modified_base (299)..(299): a, c, t, g, unknown or other
  modified_base (319)..(319): a, c, t, g, unknown or other
  modified_base (334)..(334): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttgcctggtaccagcaagaacctggccaggttcccaggctcatcatctatgtncatcacnggccatgatccagcacttgngcagtggctgggacngagttcactctcacatcagcagctgcagtctagagtatttgctagtttatactggtacaactagtacatgacgtgtacctcgtctacgtttcgggacggtaacgggccgaagggtggaagtaacgttaacgaaaacgttaccgttaggtcggtacgttcggaccacgttacttcgttcgtttcc

SEQ ID NO: 437095 - DNA, 581 bp, Homo sapiens
  misc_feature: GZ8MTXP01BKSR6.39.8.A08.1.454.CMB.2.raw
  modified_base (198)..(198): a, c, t, g, unknown or other
  modified_base (266)..(266): a, c, t, g, unknown or other
  modified_base (408)..(408): a, c, t, g, unknown or other
  modified_base (429)..(429): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccaccctctcctggtagggccagtcagagtgtagcagctaacttagcctggtaccagcaagaaccnggccaggttcccaggctcatcatctatgatcgccctaccgaccgacgggccctaagtcggtactccccgagcccgtaggttcccaggtggactaaggtcggggtactaggggaactaggtacgtttccacttctctattacncagcctagcctgactacgttntagaagttacttagacttagttttactacgtgttacagactagtatagtcgtacgtcgtaccgtacggtcggacgaaaggggtacaagggtacgaaacaccgaaacgttacgttggacggctacggcctaacctgttccgtcgtttcctaac

SEQ ID NO: 437096 - DNA, 530 bp, Homo sapiens
  misc_feature: GZ8MTXP01DJJKA.39.8.A08.1.454.CMB.2.raw
  modified_base (197)..(197): a, c, t, g, unknown or other
  modified_base (206)..(206): a, c, t, g, unknown or other
  modified_base (263)..(263): a, c, t, g, unknown or other
  modified_base (294)..(294): a, c, t, g, unknown or other
  modified_base (336)..(336): a, c, t, g, unknown or other
  modified_base (358)..(358): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctntcctgtagggccagtcagagtgtagcagcaacttagcctggtaccagcaagaaaccnggccaggttcccaggctcatcatatatggtncatccaccgagggcccactggtactcccagcctacctttagnggctaggtgggtctaggggacnggtagttcactctcaccatcagcacgcctgcagtctgaagtatttgctagtttattactggtactaatagtacattgactggtacctctcgtacgtttcgggcgggaacggaaccgttagggtcggagaagtacgaaaacgagttggtaaggctggcaccattcgttgttcc

SEQ ID NO: 437097 - DNA, 523 bp, Homo sapiens
  misc_feature: GZ8MTXP01CFLWT.39.8.A08.1.454.CMB.2.raw
  modified_base (197)..(197): a, c, t, g, unknown or other
  modified_base (261)..(261): a, c, t, g, unknown or other
  modified_base (292)..(292): a, c, t, g, unknown or other
  modified_base (336)..(336): a, c, t, g, unknown or other
  modified_base (355)..(355): a, c, t, g, unknown or other
  modified_base (395)..(395): a, c, t, g, unknown or other
  modified_base (420)..(420): a, c, t, g, unknown or other
  modified_base (443)..(443): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgtagcagcaacttagcctggtaccagcagaaccnggccaggttcccaggctcatcatctatggtncatccaccgagggcccacgtggtactcccagccctacgtttagnggcaggtgggtctgggacngtagttccactctcacatcagcagcctgcagtctagagtntttgcttagtttatctggtactaangtacaagtcgactcggtaccctntcctacgttccgggacggaagggtaccagggtggagtactcgaaacgttcttggtggctcgccacttcgtcttcgtttcc

SEQ ID NO: 437098 - DNA, 645 bp, Homo sapiens
  misc_feature: GZ8MTXP01ES96V.39.8.A08.1.454.CMB.2.raw
  modified_base (199)..(199): a, c, t, g, unknown or other
  modified_base (376)..(376): a, c, t, g, unknown or other
  modified_base (426)..(426): a, c, t, g, unknown or other
  modified_base (439)..(439): a, c, t, g, unknown or other
  modified_base (458)..(458): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccaccctatcctgtgtctccaggagaaagngcccaccctctcctgtacgggccagtcagagtgttacgcagctaacgttacgccgtaggtacccaggccaaacggaaacccgtgggaccctacgggttccccaggcctcatccatctagtcggtgcactcccacgacgggcccagtcgggtactccccgagtccctaccgtttaggnggtctagggttgggtcgtaacggggactggtacgttcacctctaccactntcacgcacgtccngcagttacgtagtaaagtntttggacttagtttattacgtaggttactaaacgtaagaactagtgacgttcggtaccttctccgtacggtttccgggcgggtaacgggtaaccgttaaggggtggaacgtaacgtaacggaaacggttacggttcgggtaacgggtccgttaacggaccctacccgttagttccgtttcggtttcc

SEQ ID NO: 437099 - DNA, 673 bp, Homo sapiens
  misc_feature: GZ8MTXP01BSO5O.39.8.A08.1.454.CMB.2.raw
  modified_base (198)..(198): a, c, t, g, unknown or other
  modified_base (226)..(226): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccacctctcctgtagggccagtcagngtgtagcagcaacttgcctggtaccagcaagaaacccgtggccacggttcccaggctcatcatctagtggtgcatcccaccgagggccctagtcggtactcccagtccctacctttaggtcggcgtagggtggggtccgtaggggaacctggtacgttccaaccttcctaccaaccgtatccgaagccgaaccggtcccgtagaccgtaggttaccgttaggtaaagtttacgtttttacggacctttaaggtttttaactttacccgttagggttaacctaaaccgtaagttaaacctaaagttcggtaaccgttcgggtccccttacgtccgttaaccggtttcgggggccggggaacgggtaaccgttaaggggtacggaagtaacgtaacgaaaacggttcgttggtcgggtctcggacctacttcgttaaccgttcgtttcc

SEQ ID NO: 437100 - DNA, 545 bp, Homo sapiens
  misc_feature: GZ8MTXP01DNJRZ.39.8.A08.1.454.CMB.2.raw
  modified_base (206)..(206): a, c, t, g, unknown or other
  modified_base (368)..(368): a, c, t, g, unknown or other
  modified_base (521)..(521): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctntcctgtagggccagtcagagtgttagcagcaacttagcctggtaccagcagaaacctggccacggttcccaggctcatcatctatggtgcatccacgaggccactggtactcccagccctaaccgttttaggcggtacgtaggtggggtcgtaagggggacnggtacgttccaactctacaccatcagctagccctgctagtcgtagtaacgtatttgacttaagtttattactggtactaactagtacaatgactggcctctcgtacgttcgggcggaagggtaccaagggtggagtaagtacaaaacggttcngtggctcggacaccatcgttgtcc

SEQ ID NO: 437101 - DNA, 626 bp, Homo sapiens
  misc_feature: GZ8MTXP01BJ5QJ.39.8.A08.1.454.CMB.2.raw
  modified_base (265)..(265): a, c, t, g, unknown or other
  modified_base (297)..(297): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctctcctggtacgggccagtcagtagtgtagcagcaacttgcctggtaccagcagaaaccnggccaggttcccaggctcatcatctagtggtncactccaccgaggcccagtcggtactccccagccctacgtttaggcggacgtagggtcgggtctaagggggactaaggtacgtttccactctccaacctatcagcacgccgtgctagtacgtagtaagttgttttgactttaagtttaacttacgttagggtaactaaacgtaacgttaactaagtcggtaccgtcggtacccttccttaccgtaccggtttcggggacgggtaacggggtaccggaaggggtcggaagtaacgtaacgttaaaacggttcgttcgggtaacggcgtaacggacctaccgttacttcgttaacgtttcc

SEQ ID NO: 437102 - DNA, 613 bp, Homo sapiens
  misc_feature: GZ8MTXP01DI5F0.39.8.A08.1.454.CMB.2.raw
  modified_base (205)..(205): a, c, t, g, unknown or other
  modified_base (294)..(294): a, c, t, g, unknown or other
  modified_base (578)..(578): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctccagatatcactggagaaatagtgatgacgcagtctccagccacctatctgtgtctcgaggagaaagcgccaccctntcctgtacgggccagtcagagtgtagcagcaacttgcctggtaccagcaagaaacctggaccaggttcccaggctcatcatctatggtncatccgacgagggccacgtcggtaactccccgaagtccctaaccgttttaggcggactaggggttcgggtacctaagggggacctaagggtacgtttccaaccttcctaccaaccgtatcgaagccaggccctagaccgtagtacgtagtaaagttattttcgactttaaggttttacttaccgtagggtacaaacgtagtaaccaatcgaacttcggacccttctacgtacgttcggggacgggaacggtaaccgagggttagaagtaactacgaaaacgttnttggtaacggctcgactacttagttccttgttccc

SEQ ID NO: 437103 - DNA, 651 bp, Homo sapiens
  misc_feature: GZ8MTXP01A7EDQ.39.8.A08.1.454.CMB.2.raw
  modified_base (265)..(265): a, c, t, g, unknown or other
  modified_base (299)..(299): a, c, t, g, unknown or other
  modified_base (404)..(404): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctccagatatcactggagaaatagtgatgacgcagtctccagccacctatctgtgtctcaggagaaagcgccaccctctcctggtacgggccagtcagagtgtagcagcaacttgccgtggtaccagcaacgtaaaccnggaccaggttcccaggcctcatcatctagtggtnctactcccgacgacgggccctaacgtcggtactccccgaacggtccctaaccgtttaggcggactaggggtcggggtctaaggggactaagggtacttccactcncaccatcagcgacgtcctgactagttacgtagtaagttatttcgacttaaggtttacaccgtacgtcggtacaaggtctaagttagtcggtactaacctaagaaaacgggttccggttaaccggaaccggaaaaggggtaaccttaaagggggtaaacttaaaacgtaaacccggtaaaaacggttacgttgggttccggaaccttggaacctaacctagtttccgtaacggtttaacccttaaccg

SEQ ID NO: 437104 - DNA, 558 bp, Homo sapiens
  misc_feature: GZ8MTXP01AYESS.39.8.A08.1.454.CMB.2.raw
  modified_base (197)..(197): a, c, t, g, unknown or other
  modified_base (362)..(362): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccaccctctcctgtagggccagtcagagtgttagcagcaacttagcctggtaccagacaaaactggccagactcccaggctcctcatgtatggtgccgtcccaccgagggccacgtggtactcccgagccaggttcagtcggcaggtgggtctggggaacagngttcagtctcacatcagcagctgcagtctagaagtattttgtactttatactgtcagggctagtatgtaatccgtggcctcgacgttcttttcgggaccgagggggtaaccctaggggttggaacggttattaaccgaaacgttacgttgggttaggtaacgtcggaacctaccgattccgttgttaacctttccg

SEQ ID NO: 437105 - DNA, 676 bp, Homo sapiens
  misc_feature: GZ8MTXP01EM5GF.39.8.A08.1.454.CMB.2.raw
  modified_base (299)..(299): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgcccaccctctcctggtacgggccagtcagagtgtagcagctaacttgcctggtaccagcaagaaccgtggccaggttcccaggctcatcatctagtggtnctactccaccgagggccctagtcggtactcccgagtccctaccgttttaggcggtacgtagggtcggggtaccgtaacgggggactaaggtacgtttccaccgttcctaccgaccatccgaggcacggtcccgtagcctagttacgtaggtaaagttgttttcgacgtttaagttttacttacgttcggtaactaaacgtagttaacgaaagttcgtaaccgtcggtacccttcgttaccgttaccggtttccgggggaacggggtaacggggtaaccgttaaagggggtcggttaaacgtaacgttaaccgaaaacggttccgttagggtccggtcttaaccggaccctaccgttacgttccgttaacggtttccc

SEQ ID NO: 437106 - DNA, 619 bp, Homo sapiens
  misc_feature: GZ8MTXP01AF18K.39.8.A08.1.454.CMB.2.raw
  modified_base (431)..(431): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgcccaccctctcctggtacgggccagtcagagtgttagcagcaacttgcctggtaccagcagaaacctggaccaggttcccaggctcatcatctagtggtgacactccaccgagggcccacgtcggtactcccgagccctacgtttaggcggcgtaggttgggtcgtaggggacctaaggtacgttccacttctcacctagtccagtcacgcctgcctagtactagtaaagttntttgactttaagtttacttacgtacggtactaaacgtagtaacaagttgaccgttgtacccctgttaccgtaccggtttacggggcgggtaaacggggacccgttaaaggggtcgggaaagtaacgtaaaccgaaacgttacggttcggtcgggtactcgggacctacgttattccgttaagttcccc

SEQ ID NO: 437107 - DNA, 759 bp, Homo sapiens
  misc_feature: GZ8MTXP01AWYUN.39.8.A08.1.454.CMB.2.raw
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctctcctgtagggccagtcagagtgtagcagcaacttagcctggtaccagcaagaaaccgtggaccaggttcccaggctcatcatctagtggtgacactacccgacgacgggccctacgtcggtacctccccgaagtcccctaaccgttttaggcggtcgtaggggttcggggtcgtaacggggaacctaaggtacgttccaccgttcctaccaaccctagtaccgacgccaacggtccctacggacctaagggttccctaagggttaaacggtttacgttttttacggaccgttttaaaggttttttaaccgttttaaccggttacggggtttaaacccaaaaccgtttaacgggtaaaacccttaagttaccgggtaccgttaccgggttacccctttaccgttaccggttaccgggttttaccgggggaccggggtaaacggggtaaacccggttaaagggggttaccggaaaggtaaacgttaaccggaaaaccggttggttcggttaaccgggacttcgggaacctacccttagtttccgttgtttaaccc

SEQ ID NO: 437108 - DNA, 576 bp, Homo sapiens
  misc_feature: GZ8MTXP01BJZCM.39.8.A08.1.454.CMB.2.raw
  modified_base (266)..(266): a, c, t, g, unknown or other
  modified_base (404)..(404): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgcccaccctctcctgtacgggccagtcagagtgttagcagcaacttagcctggtaccagcagaaaccnggccaggttcccaggctcatcatctatggtgtactccacgagggccacgtggtactcccagtcctaccgtttaggcgcgaggtgggtctggggaacagtgttcactctcaccatcagcagcctgcagtctagaagttntttgattagtttattacttgtactaactagtactaagtcgtacgtcggtcccttcgttacgtacgtttccgggacgggtaacgggaaccgtaagggttcggaaagttacgtaacgaaaacgttacgttggttcggtaactcggaacctaacgacttcgtcgttctttaaccg

SEQ ID NO: 437109 - DNA, 592 bp, Homo sapiens
  misc_feature: GZ8MTXP01DTZVK.39.8.A08.1.454.CMB.2.raw
  modified_base (197)..(197): a, c, t, g, unknown or other
  modified_base (205)..(205): a, c, t, g, unknown or other
  modified_base (295)..(295): a, c, t, g, unknown or other
  modified_base (306)..(306): a, c, t, g, unknown or other
  modified_base (321)..(321): a, c, t, g, unknown or other
  modified_base (420)..(420): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggagaaatagtgatgacgcagtctccagccaccctatctgtgtctcaggagaaagngccacctntcctgtaggccagtcagagtgttagcagctaaacgttgcctggtaccagcaagaacctggccaggttcccaggctcatcatctagtggtncaactccacgngggcccagtggtacncccgagcctacgtttgcggtctaggtcgggtcgtaggggactggtacgttcacgtctacacctagtccagtcacgcgtcgctagttacgtagtaagttntttacgacttagtttaattaccgttgggtaactaaagtaacgtaactaagtcgtacgtcggtcccttcgtccgtacggtttcgggcgggtaacgggaccaggtcgttagggaactaacgttaacgttaaacggacgttggcgtcgtcgaccttacgtaacttcgtttaaccg

SEQ ID NO: 437110 - DNA, 664 bp, Homo sapiens
  misc_feature: GZ8MTXP01C815A.39.8.A08.1.454.CMB.2.raw
  modified_base (204)..(204): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctccagatatcactggagaaatagtgatgacgcagtctccagccacctatctgtgtctccgaggagaaagcgccacctntccgtggtacgggccagtcaggtagttgtagcagtactaaacgtttagccgtaggtaacccagaccaacggaaaccgtcggacccgtacggttcccaggtcctcaatcaattcctagtggtcgcctacgtacccgaccggtagggccctaacgtcgggtacctaccccgagtcccttaaccgttttaagggcgggtacgtaggggttcgggtaccgtagggggaactggtacgtttccaactcctacacatcgagcagcctgcctagtactaggtaattgtttcacgttagtttattacgtcggtaacaaacgtagttaacgaagttcgtacgtcggttacctcgtcgtacggtttccgggaacggggtaacggtaaccggttaggggtacgaacgtaacgtaaacaaacggttccgttggttaacggctcggaccacgttacttccgttcgtttaaccc

SEQ ID NO: 437111 - DNA, 780 bp, Homo sapiens
  misc_feature: GZ8MTXP01CZAGR.39.8.A08.1.454.CMB.2.raw
  modified_base (300)..(300): a, c, t, g, unknown or other
tcagtcgcactagtcacgaccggtgctcgatttagcatactctacaggggggaggaactgctcagttaggacccagacggaaccatggaagccccagcgcagcttctcttcctcctgctactctggctcccagatatcactggaagaaatagtgatgacgcagtctccagccaccctatctgtgtctccgaggagaaagcgcccacctctccgtggtagggccagtcagtagtgtagcagctaacttgcctggaccagcaagaacctggcctaggtcccaggcctcatcatctagtggtncactcccaccgagggcccaagtcggtacctccccgagtcccttaaccgttttaggcgggacgtaggggttcggggtaccgtagggggaacctaaggggtaccgttttacccaccgttaccctaccgaaaccccgtatacccgacgggaccctaacgggtccccgttaggacccgttaaagggttaccgtttaagggttaaaacggttttcgtttttaacgggaccttttaaaggtttttaaactttacccggtttacggggttaaccctaaaacggttaacgttaacctaaaggttccggtaaccgttccgggtacccctttcgtaccggtttaccggttaccggggggaacggggtaaaccggggtaacccgttaaagggggttaggaaacggttaaacgtaacccggttaaaaacgggttccggttgggtaaccgggtcctcgggtaccctaccgttacgtttccgttaacgtttccc

SEQ ID NO: 437112 - DNA, 556 bp, Homo sapiens
  misc_feature: GZ8MTXP01CDYE6.39.8.A08.1.454.CMB.2.raw
  modified_base (198)..(198): a, c, t, g, unknown or other
  modified_base (340)..(340): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagcccaccctatctgtgtctccaggagaaagngccacctctcctgtacggccagtcagagtgttagcagcaacttgcctggtaccagcagaaacctggccaggtcccaggctcatcatctagtggtgcactccaccgagggcccacgtggtactcccgagtcctacctttaggnggcgtaggtcgggtctaggggactgtacgttccactctcgacctatccagcagcctgctacgtctagtaagttattttcggcttaggtttacttcgttaggactaaacgtagtacaagtcgacctggtcctgtactacgttcggcgggtaagggacttagggtggacgtacgtacgaaacgttcgttgcgggctgcctacgttattcgttcgttcc

SEQ ID NO: 437113 - DNA, 591 bp, Homo sapiens
  misc_feature: GZ8MTXP01CANG3.39.8.A08.1.454.CMB.2.raw
  modified_base (387)..(387): a, c, t, g, unknown or other
  modified_base (443)..(443): a, c, t, g, unknown or other
tcagtcgcactagtcacgaccggtgctcgatttagcatactctacagggggaggaactgctcagttaggacccagacggaaccatggaagcccagcgcagcttctcttcctcctgctactctggctccagatatcactggagaaatagtgatgacgcagtctccagccacctatctgtgtctccaggagaaagcgccacctctcctggtacggccagtcagagtgttagcagactaaacttacgcctaggtaccagacaagaaaccgtggccaggttcccaggctcaatcatctagtggtgacactccaccgtacgggcctaacgtggtacctacccgagtaccctaccgttttacggcggacgtaggtcgggtcgtacggggaacngggtacttccactctaccaccgtataccacgcacggcctgactaggtctaggtatntttagactagtttatacgtggtactaagtagtaactaatcgactcggtcctctccgtacgttcgggacgtaacggggaacttaggggtagagtaagtacgttaaaacgttcgttgtaaggtcgcgtaccacgttactcgttcgttccg

SEQ ID NO: 437114 - DNA, 628 bp, Homo sapiens
  misc_feature: GZ8MTXP01C87AM.39.8.A08.1.454.CMB.2.raw
  modified_base (208)..(208): a, c, t, g, unknown or other
  modified_base (288)..(288): a, c, t, g, unknown or other
  modified_base (416)..(416): a, c, t, g, unknown or other
  modified_base (609)..(609): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtcctcgaggagaaagcgcccaccctntccgtggtacggccagtcagtagtgtagcagctaacttgcctggaccagcaagaacctggccaggcctccaggcctcctnatcatgactcgccctccgaccgacgggccctacgtcggtactccccgagtccgtaggtttcccaggtggacgtaaggtggggtaaccgtaggggaacctaggtacgttaccacgttctactaattacncgacgtccgtacgccgtgactaggttctaagtaacgttattacgtacgtttagtttacttacggtgtacgaagtactaagttaatacgtcgtaacggtcgtacccgttaaggtcccgggacgaaacgggacgttaaagggttacgaaaacgttacgaaccggttagttgttacgggtctacgcctaacccgtnttccgtcgttcccttaacg

SEQ ID NO: 437115 - DNA, 513 bp, Homo sapiens
  misc_feature: GZ8MTXP01A2WG9.39.8.A08.1.454.CMB.2.raw
  modified_base (354)..(354): a, c, t, g, unknown or other
  modified_base (373)..(373): a, c, t, g, unknown or other
  modified_base (376)..(376): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagcccacctctcctgtaggccagtcagagtgtagcagcaacttgcctggtaccagcagaaacctggccaggtcccaggctcatcatctatggtgcatccaccgagggcccacgtggtactcccagcctaccgtttagtcggcagtgggtctggggacngagtcactctcaccatcancanctgcagtctgagatttgctagttattacgttgtacaactagtacagtgacgtcgtcctctcgtacgttcgggcggaagggaacgttaggtaggagtactaacgaacgttacgttcggtgctcgcaccatcgttcgtc

SEQ ID NO: 437116 - DNA, 720 bp, Homo sapiens
  misc_feature: GZ8MTXP01BCLZC.39.8.A08.1.454.CMB.2.raw
  modified_base (262)..(262): a, c, t, g, unknown or other
  modified_base (287)..(287): a, c, t, g, unknown or other
  modified_base (347)..(347): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacnggccgaggttcccaggctcatcatntatggtgctatcccaccgacgggccctagtcggtactaccccgagccctaccgtttaggnggacgtaggtggggtctagggggaacaaggtagttccacgttcctacacccatcccgagccacgccgtgccaagttccgtagttaaacgttgtttttacggacgtttaaagttttacgtttaaccgttacggttaacccgtaaacgttaaaccgggttaaactaacggtttaccggtaaccgttcgggttaaccccgttctttaccccggttacggttttaccgggggccggggtaaaccggggttaaccggaaacggggttagggttaaaggaaacgttaaaccggaaaaccgggttaaaccgttcggggtttaacgggtacgttaaccggtaacccggtaaccttacgttaaccgtttcggtttaaccccg

SEQ ID NO: 437117 - DNA, 700 bp, Homo sapiens
  misc_feature: GZ8MTXP01B4Y00.39.8.A08.1.454.CMB.2.raw
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccgaaggaagaaacgcgcccacctctccgtggtacgggccagtcgagtagtgtagcagctaactgcctggtaaccagacaagaacctggacctaggttcccaggctacgatcatctagtcgtgacacctaccgaacggtcgggaccctacgtcggtaactcccccgtagtcccttaaacggtttcggcgggtctaaggggtcgggtcgtaagggaacctgggtaacttcctaaccgttacctaccgaacccgtagtacccgaacgaccgtacggtccctaggtaccgtaacggttccgttaaacggtaaggtttagttttcgacggtttaaacttttacgttaacgttcgggtaaactaaacgtagttacaaacgttcgtccgtaggtccctgttacccggttagttccgggggaaggtaacggggtaaccgaagggtacggaaagtaacgtaaccgttaaacgttacgttcgggttcgacgttccgaacacgttcttaacgtttcgtttaaccc

SEQ ID NO: 437118 - DNA, 491 bp, Homo sapiens
  misc_feature: GZ8MTXP02F5ESH.39.8.A08.1.454.CMB.2.raw
  modified_base (352)..(352): a, c, t, g, unknown or other
  modified_base (385)..(385): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggcccactggtatcccagccacctttagtggcagtgggtctggggacngagttcactctcaccatcagcagcctgcagtcngaagattttgctagtttattactgtcaacagtacaatgactggctctcactttcggcggaggaccaggtggagatacgaaacgactagtggctgcaccatctgttc

SEQ ID NO: 437119 - DNA, 510 bp, Homo sapiens
  misc_feature: GZ8MTXP02I0X84.39.8.A08.1.454.CMB.2.raw
  modified_base (352)..(352): a, c, t, g, unknown or other
tcagtcgcactagtcacgaccggtgctcgatttagcatactctacaggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggcccacgtggtactcccagcctacctttagtgcaggtggtctgggacngagttcactctcaccatcagcagcctgcagtctgaagtattttgctagtttattacttgtacaacagttacaattgactggcctactctacgtttcggcggtacgggaccgaaggtggagactcgaaaacgactgaaggctagacacctatctgttcc

SEQ ID NO: 437120 - DNA, 537 bp, Homo sapiens
  misc_feature: GZ8MTXP02GDDSC.39.8.A08.1.454.CMB.2.raw
  modified_base (334)..(334): a, c, t, g, unknown or other
  modified_base (377)..(377): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcacctacttagcctggtaccagcagaaacctggccaggcctcccaggcctcctcatctatggtgcatccaccgagggcccacgtggccacgtccccganacggttcaggtggcaggtgggtctggggacaggacttcactcncaccatcagcagactggacgcctagaacgtatttgctagtgttattactgtcagcagtatggtagctctaccttccaccgttcggaccgaaacgggtaccacggacgtaggaacgtaacgttaaaacgaacgttggtacggtctaggaccacctattccg

SEQ ID NO: 437121 - DNA, 504 bp, Homo sapiens
  misc_feature: GZ8MTXP02JGSOO.39.8.A08.1.454.CMB.2.raw
  modified_base (293)..(293): a, c, t, g, unknown or other
  modified_base (331)..(331): a, c, t, g, unknown or other
  modified_base (351)..(351): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggtcccaggctcatcatctatggtncatccacagggcccatggtactcccagccacctttagnggcagtggggtctggggacngagttcactctcaccatcagcagcctgcagtctgaagtatttgactagtttattacttgtacaactagtacaatgactggtacctcttcacgtttcggcggtacgggaccgaaggtcggagacgtacaaacgactgtggctgcacactctgtc

SEQ ID NO: 437122 - DNA, 518 bp, Homo sapiens
  misc_feature: GZ8MTXP02GYUM4.39.8.A08.1.454.CMB.2.raw
  modified_base (197)..(197): a, c, t, g, unknown or other
  modified_base (293)..(293): a, c, t, g, unknown or other
  modified_base (354)..(354): a, c, t, g, unknown or other
  modified_base (370)..(370): a, c, t, g, unknown or other
  modified_base (393)..(393): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggtcccaggctcatcatctatggtncatccaaccagggccactggtactcccgagccctacctttagtgcagtgggtctggggacnggagttcactctcacntcagcagcctgcagtctgaagtntttgctagtttattactgtacaacagtacaatcgactggcctctctacgtttcgggcggacgggaccaagggtcgaagactaccgaaaacgtactggtaaggcctaggaccacctatctagttcc

SEQ ID NO: 437123 - DNA, 528 bp, Homo sapiens
  misc_feature: GZ8MTXP02G4TYM.39.8.A08.1.454.CMB.2.raw
  modified_base (294)..(294): a, c, t, g, unknown or other
  modified_base (336)..(336): a, c, t, g, unknown or other
  modified_base (356)..(356): a, c, t, g, unknown or other
  modified_base (421)..(421): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtncatccacgagggcccacgtggtactcccagcctacctttagnggcaggtgggtctggggacnggtagttcactctcaccatcagcagcctgcagtctgaatatttgactagtttatactgtactaanagtacaatgactcggtctctctacgtttcgggcggtaacgggaccgtaagggtcggaagactacgaaaacgacgtaggtcggctacggaccaccactcgtacgttcc

SEQ ID NO: 437124 - DNA, 528 bp, Homo sapiens
  misc_feature: GZ8MTXP02JIANO.39.8.A08.1.454.CMB.2.raw
  modified_base (293)..(293): a, c, t, g, unknown or other
  modified_base (355)..(355): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtaggccagtcagagtgttagcagcaacttagcctggtaccagcagaaacctggccaggttcccaggctcatcatctatggtncatcccacgagggcccagtggtactcccagccctacctttagtggcagtgggtctggggacngagttcactctcacatcagcagcctgcagtctgaagtatttgctagtttatactgtacaacagtacaatcgactggcctctctacgtttcgggcggaacgggaccagggtcggaagtactaccgaaaacgacgtaggtcgggacttacggccaaccgtatccgtagtttcccg

SEQ ID NO: 437125 - DNA, 487 bp, Homo sapiens
  misc_feature: GZ8MTXP02GMVCG.39.8.A08.1.454.CMB.2.raw
  modified_base (340)..(340): a, c, t, g, unknown or other
  modified_base (355)..(355): a, c, t, g, unknown or other
  modified_base (470)..(470): a, c, t, g, unknown or other
tcagtcgcactagtcacgaccggtgctcgatttagcatactctacaggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccacaggccatgtatccagccacttagtgcagtggtctgggacngagttcactctcacntcagcagcctgcagtctgagtatttgactagtttatactgtacaacagtacaatgactggcctctctacgtttcggcggtaggaccgaggtacggagacgtacgaaacgactagnggctgcaccatctcgtc

SEQ ID NO: 437126 - DNA, 583 bp, Homo sapiens
  misc_feature: GZ8MTXP02IW59A.39.8.A08.1.454.CMB.2.raw
  modified_base (294)..(294): a, c, t, g, unknown or other
tcagtcgcactagtcacgaccggtgctcgatttagcatactctacagggggaggaactgctcagttaggacccagacggaaccatggaagccccagcgcagcttctcttcctgctgctactctggctcccagatatcactggagaaatagtgatgacgcagtctccagccaccctatctgtgtctccaggaagaaagagccaccctctcctgtacgggccagtcagagtgttagcagcaacttgcctggtaccagcagaaacctggccaggtcccaggctcatcatctatggtncatccaccgagggccacgtcggtactccccagccctacccgtttagcggctaggtgggtccgttggggactaggtacgttcactctacacctatcagcacgcctgctagtctagaagttatttgacttagtttattacgtgttaccaaatagtaacaagtgtactcggtccttactccgtacgtttcgggacgggtaacgggaaccggtaagggtacgggaacgtaacgtaaccgtaaaacggtaacgtcggtacggtaccgtcggacctaacccgtatttccgtttcg

SEQ ID NO: 437127 - DNA, 562 bp, Homo sapiens
  misc_feature: GZ8MTXP02IVRXV.39.8.A08.1.454.CMB.2.raw
  modified_base (197)..(197): a, c, t, g, unknown or other
  modified_base (335)..(335): a, c, t, g, unknown or other
  modified_base (355)..(355): a, c, t, g, unknown or other
  modified_base (357)..(357): a, c, t, g, unknown or other
  modified_base (394)..(394): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggttcccaggctcatcatctatggtgcatccaccagggcccactggtactcccagcctacctttagnggcaggtgggtctggggacngngttcactctcaccatcagcagcctgcagtctagaatntttgctagtttattactgtacaactagtaacaatcgactcggaccttctacgtacgtttcgggacgggtaacgggaccgtaaaggggtcggaaagtaacgttaaccgaaaacggtaacgttgggtaacggtacgttacggacctaaccgtacttcgttacggtttccc

SEQ ID NO: 437128 - DNA, 509 bp, Homo sapiens
  misc_feature: GZ8MTXP02IYXVD.39.8.A08.1.454.CMB.2.raw
  modified_base (332)..(332): a, c, t, g, unknown or other
  modified_base (351)..(351): a, c, t, g, unknown or other
  modified_base (354)..(354): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaacctggccaggtcccaggctcatcatctatggtgcatccacagggcccactggtactcccagccctactttagnggcaggtgggtctgggacnggngttcactctcaccatcagcagcctgcagtctgaagtattttgactagtttattacgttgtactaacagtaacaatgactggcctctctacgttcggacggtacgggaccagggtaggagactacgaaacgactggtgctcgcactagtctcgttc

SEQ ID NO: 437129 - DNA, 582 bp, Homo sapiens
  misc_feature: GZ8MTXP02F3PQN.39.8.A08.1.454.CMB.2.raw
  modified_base (377)..(377): a, c, t, g, unknown or other
  modified_base (401)..(401): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaacctggccaggctcccaggctcctcatctatgatcgccctccaccgagggcccacgtggtactcccagccaggttccagtggacagtgggtctggggacagtacgttcactctcattancagcagcctgctagtctagaagtnttagctaagtttatactgtacagtctagtaataagtgtacgtggtacccttaaggttccgggaaccgtaaaacggggtacccgtaaaggggtttagggaaaaactaccgtaaaaacggtaaccgttgggttacgggaacttacggacctaaacccgttagttaccgttacgttaccttacg

SEQ ID NO: 437130 - DNA, 521 bp, Homo sapiens
  misc_feature: GZ8MTXP02GVBDU.39.8.A08.1.454.CMB.2.raw
  modified_base (197)..(197): a, c, t, g, unknown or other
  modified_base (354)..(354): a, c, t, g, unknown or other
  modified_base (421)..(421): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggttcccaggctcatcatctatggtgcatccacagggccactggtatcccagcctacctttagtggcaggtcggggtctggggacngtagttcactctcaccatcagcagcctgcagtctagaagtatttgactagtttattactgtacaaanagtaacaatcgacgtggacctctcgtacgtttcggcgggtacgggaccgaaaggggtcgaagtacgtacaaaacgactagtggctcgacacactctgttc

SEQ ID NO: 437131 - DNA, 513 bp, Homo sapiens
  misc_feature: GZ8MTXP02HEDPA.39.8.A08.1.454.CMB.2.raw
  modified_base (197)..(197): a, c, t, g, unknown or other
  modified_base (292)..(292): a, c, t, g, unknown or other
  modified_base (329)..(329): a, c, t, g, unknown or other
  modified_base (346)..(346): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttgcctggtaccagcagaaacctggccaggtcccaggctcatcatctatggtncatccacaggccactggtactcccagcctactttagnggcagtgggtctggacngagttcactctcacatcagcagcctgcagtctagaagtatttgctagtttattactgtacaacagtaacaatgactcggcctctctacgtttcggacggacggaccagggtacgagtacgtacgaaaacgtacgtggtcggctcgacctaaccgactccgttagtcc

SEQ ID NO: 437132 - DNA, 535 bp, Homo sapiens
  misc_feature: GZ8MTXP02F5VGV.39.8.A08.1.454.CMB.2.raw
  modified_base (197)..(197): a, c, t, g, unknown or other
  modified_base (294)..(294): a, c, t, g, unknown or other
  modified_base (361)..(361): a, c, t, g, unknown or other
  modified_base (432)..(432): a, c, t, g, unknown or other
  modified_base (530)..(530): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggttcccaggctcatcatctatggtncatccaccgagggcccactggtactccccagccctaccgtttagcggcaggtggggtctggggaacnggtagttcacttctccacatcagcagccctgcagttcagtaagtatttgactagtttattactgtactaanagtaacaatagactgccttctcgtacgtttcgggacggtacgggaccgaagggtcggaagacgtacgaaaacgacgtagtcgctacgacaccatcgtnttacc

SEQ ID NO: 437133 - DNA, 565 bp, Homo sapiens
  misc_feature: GZ8MTXP02GA1P4.39.8.A08.1.454.CMB.2.raw
  modified_base (295)..(295): a, c, t, g, unknown or other
  modified_base (333)..(333): a, c, t, g, unknown or other
  modified_base (352)..(352): a, c, t, g, unknown or other
  modified_base (400)..(400): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctccagatatcactggagaaatagtgatgacgcagtctccagccacctatctgtgtctccaggagaaagcgccacctctcctggtacgggccagtcagagtgttagcagcaacttcgcctggtaccagcaagaaacctggccaggttcccaggctcatcatctagtggtncactccacgaggccagtggtactccagcctacgttagnggcaggtggtctggggacnggacgttcactcctcaacctatcagcacgctgctagtctagaacgttntttgactagttttaatactagtacaatagtaacaagtacgacgtacggtcctctcgtacggtttcggggacggtaacgggaaccggtagggtacggaaacgtaaacttaacgaaaacggtacgtacggcggtctacggacctacctacgttccgtagtttacccg

SEQ ID NO: 437134 - DNA, 540 bp, Homo sapiens
  misc_feature: GZ8MTXP02G9DDQ.39.8.A08.1.454.CMB.2.raw
  modified_base (190)..(190): a, c, t, g, unknown or other
  modified_base (195)..(195): a, c, t, g, unknown or other
  modified_base (204)..(204): a, c, t, g, unknown or other
  modified_base (225)..(225): a, c, t, g, unknown or other
  modified_base (289)..(289): a, c, t, g, unknown or other
  modified_base (292)..(292): a, c, t, g, unknown or other
  modified_base (313)..(313): a, c, t, g, unknown or other
  modified_base (363)..(363): a, c, t, g, unknown or other
  modified_base (370)..(370): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctccagatatcactggagaaatagtgatgacgcagtctccagccacctatctgtgtctccagganaaagngccaccctntcctgtaggccagtcagagtnttagcagcaaacttgcctggtaccagcagaaacctggccaggtcccaggctcatcatcatggancancacgacggctatgtactccanctacttacgtgcgagtggtcgtcggacgagagtctactctacacacacanacacgcngcagtacgtagtaagtagtttagttagtttatttgttgtacgtagtatagtaataaataactacgtcgtcgtcgtcgtacgtacgtacgtacgaacggaaacgtaaacgtaagtaaacgtaacgaaaacgaaacgtacgtaagtacgtacgacgacactacgtacgtacg

SEQ ID NO: 437135 - DNA, 505 bp, Homo sapiens
  misc_feature: GZ8MTXP02HUIBI.39.8.A08.1.454.CMB.2.raw
  modified_base (334)..(334): a, c, t, g, unknown or other
  modified_base (354)..(354): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggcccactggtatcccagcctacctttagnggcaggtgggtctggggacngagttcactctcaccatcagcagcctgcagtctgaagtatttgctagtttattactgtactaagagtacaattgactggcctctctacgtttcggcggtacgggaccagggtcgaggatacgaaacgactgtaaggctgcacactctgttc

SEQ ID NO: 437136 - DNA, 543 bp, Homo sapiens
  misc_feature: GZ8MTXP02FZ0SS.39.8.A08.1.454.CMB.2.raw
  modified_base (363)..(363): a, c, t, g, unknown or other
  modified_base (407)..(407): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatcccaccgagggcccacgtggtactccccgagccctacctttaggtggcaggtggggtctggggacnggacgttcactcctcaccatcagcacgcctgcagtctgtaagtntttgcttagtttattactgtacaatagtaacaatcgactggcccttctccgtacgtttcgggacggtaacgggaccgaagggtcggaagacgtacgaaaacgacgtggtaacggctcgaccgactacgtctcgttc

SEQ ID NO: 437137 - DNA, 518 bp, Homo sapiens
  misc_feature: GZ8MTXP02IH1OF.39.8.A08.1.454.CMB.2.raw
  modified_base (339)..(339): a, c, t, g, unknown or other
  modified_base (360)..(360): a, c, t, g, unknown or other
  modified_base (377)..(377): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaacctggccaggttcccaggctcatcatctatggtgcactccaccgagggcccacgtggtactccccagccctacctttagnggcaggtggggtctggggacnggagttcactcctcacntcagcagcctgcagtctgaagtatttgctagtttattacgtgtacaactagtacaatcgactggtcctctctacgtttcggcggacggaccgagggtggagagtacgaaacgtacgtggtgctacgcactactctcgttcc

SEQ ID NO: 437138 - DNA, 497 bp, Homo sapiens
  misc_feature: GZ8MTXP02G8QN3.39.8.A08.1.454.CMB.2.raw
  modified_base (251)..(251): a, c, t, g, unknown or other
  modified_base (292)..(292): a, c, t, g, unknown or other
  modified_base (315)..(315): a, c, t, g, unknown or other
  modified_base (330)..(330): a, c, t, g, unknown or other
  modified_base (350)..(350): a, c, t, g, unknown or other
  modified_base (379)..(379): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtaggccagtcagagtgtagcagcaacttagcctggtaccngcagaaacctggccaggttcccaggctcatcatctatggtncatccaccagggcccatggtacncccagcctactttgnggcaggtgggtctggggacngagttcactctcaccatcagcagcctgcngtctgaagtattttgctagtttattactgtacaactagtacaaatgactcggctctctacgtttcggcggtaggacaggtcggagagtacgaaacgaatgtggctgcactactctctc

SEQ ID NO: 437139 - DNA, 555 bp, Homo sapiens
  misc_feature: GZ8MTXP02HU83Q.39.8.A08.1.454.CMB.2.raw
  modified_base (197)..(197): a, c, t, g, unknown or other
  modified_base (293)..(293): a, c, t, g, unknown or other
  modified_base (335)..(335): a, c, t, g, unknown or other
  modified_base (356)..(356): a, c, t, g, unknown or other
  modified_base (401)..(401): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctggtagggccagtcagagtgttagcagcaacttgcctggaccagcaagaaacctggccaggtcccaggctcatcatctatggtncatccaccgagggcccagtggtactcccagccctactttagnggctaggtgggtctggggacnggtgttcactcctacaccatcagcacgcctgcagtctagtaattntttgcttagtttattactgtacaaacgtagtaacatcgactcggtccttcgtacctcgtttcggggacgggtaacgggaccgtaaagggtcggaagtaacgtacgaaaacgtacgtaggtaacggtctacggacctacgtactcgttacgttcc

SEQ ID NO: 437140 - DNA, 586 bp, Homo sapiens
  misc_feature: GZ8MTXP02HHT6D.39.8.A08.1.454.CMB.2.raw
  modified_base (197)..(197): a, c, t, g, unknown or other
  modified_base (292)..(292): a, c, t, g, unknown or other
  modified_base (332)..(332): a, c, t, g, unknown or other
  modified_base (342)..(342): a, c, t, g, unknown or other
  modified_base (348)..(348): a, c, t, g, unknown or other
  modified_base (351)..(351): a, c, t, g, unknown or other
  modified_base (370)..(370): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttgcctggtaccagcagaacctggccaggttcccaggctcatcatctatggtncatccacgagggcccagtggtactcccagcctactttagngcagtggtcngggacnggnttcacgtctacaccatcancacgctgcagtctagaagtattttgacttagtttacttacgttagtactaaatacgtaacaagtcgtacgtcggtcccttactccgttaacggtttccgggaccggggtaaacggggtaacccgtaaagggggttacgggaaagtaacgtaaaccgaaaacggtaacgttggtaacgggtactacggacctaacctacgttccttcggtttacccg

SEQ ID NO: 437141 - DNA, 528 bp, Homo sapiens
  misc_feature: GZ8MTXP02JSGU0.39.8.A08.1.454.CMB.2.raw
  modified_base (365)..(365): a, c, t, g, unknown or other
  modified_base (508)..(508): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatcccaccgaggggcccacgtggtactccccgagccctaccgtttagtcggctaggtgggtctggggacnggagttcactctcacatcagcagcctgcagtctagaagtattttgcttagtttacttacttgtacaaatagtaacaatcgacgtcggtacctctcgtacgtttcggacggtacgggacgagggtggagactacgaaacgatgngctcgacacgactcgtgttc

SEQ ID NO: 437142 - DNA, 524 bp, Homo sapiens
  misc_feature: GZ8MTXP02G5WTT.39.8.A08.1.454.CMB.2.raw
  modified_base (291)..(291): a, c, t, g, unknown or other
  modified_base (332)..(332): a, c, t, g, unknown or other
  modified_base (352)..(352): a, c, t, g, unknown or other
  modified_base (400)..(400): a, c, t, g, unknown or other
  modified_base (441)..(441): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgtagcagcaacttgcctggtaccagcagaacctggccaggttcccaggctcatcatctatggtncatccacgagggcccagtggtactcccagccctactttagnggcaggtgggtctggggacnggtacgttcactctacaccatcagcagcctgcaggctagaagtagtgngactagtttatactgtacactaatattaataactctacctntacgttacgtttcggaccgaacgggaccaggcgtaggactacgtacgaaacgtaactggtcgacgtcgaccacgtactcttcg

SEQ ID NO: 437143 - DNA, 513 bp, Homo sapiens
  misc_feature: GZ8MTXP02JDGIK.39.8.A08.1.454.CMB.2.raw
  modified_base (357)..(357): a, c, t, g, unknown or other
  modified_base (397)..(397): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaacctggccaggtcccaggctcatcatctatggtgcatccaccgacgggccactggtactcccagcctaccgtttagtcggctaggtgggtctggggacnggtagttcactctacacatcagcagcctgcagtctgaatntttgactagtttattactgtactaactagtacaatgacgtgcctctcgtacgttcgggacggacggaccgaggtggaagactacgaaacgacgtgtaagctcgacacactcgtgtc

SEQ ID NO: 437144 - DNA, 536 bp, Homo sapiens
  misc_feature: GZ8MTXP02FWGX0.39.8.A08.1.454.CMB.2.raw
  modified_base (252)..(252): a, c, t, g, unknown or other
  modified_base (337)..(337): a, c, t, g, unknown or other
  modified_base (357)..(357): a, c, t, g, unknown or other
  modified_base (392)..(392): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccacctctcctgtagggccagtcagagtgttagcagcaacttagcctggtaccngcagaaacctggccaggtcccaggctcatcatctatggtgcatcccaccgagggcccactggtaactcccagtccctactttagnggcaggtgggtctggggacnggagttcactcctcacatcagcacgcctgcagtcngaagtatttgacttagtttattactgtacaactagttaacaatcgacgtggcctctacacgtttcggcgggtaacgggaccgaaagggtcggagtacgtaccgaaaacgacgttggcgtcgtcgaccacctactctcgtttacc

SEQ ID NO: 437145 - DNA, 553 bp, Homo sapiens
  misc_feature: GZ8MTXP02JQR5B.39.8.A08.1.454.CMB.2.raw
  modified_base (197)..(197): a, c, t, g, unknown or other
  modified_base (295)..(295): a, c, t, g, unknown or other
  modified_base (338)..(338): a, c, t, g, unknown or other
  modified_base (360)..(360): a, c, t, g, unknown or other
  modified_base (374)..(374): a, c, t, g, unknown or other
  modified_base (379)..(379): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctggtagggccagtcagagtgttagcagcaacttgcctggtaccagcagaaacctggaccaggttcccaggctcatcatctatggtncatccaccgagggcccagtggtactcccagccctacgtttagnggctaggtggggtcaggggacnggtacgttcactcncaccntcagcagcctgcagtctagaagtatttgacttagtttatactgtacaactagtacaatgacgtggtacctctcgtaccggtttcgggacgggtaacgggtaccgaaggggtaggaagtacgtaaccgaaaacggtaacgtggtaacggctacgacgacctacttctcgtttacc

SEQ ID NO: 437146 - DNA, 571 bp, Homo sapiens
  misc_feature: GZ8MTXP02ITT7X.39.8.A08.1.454.CMB.2.raw
  modified_base (197)..(197): a, c, t, g, unknown or other
  modified_base (364)..(364): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctggtagggccagtcagagtgttagcagcaacttagcctggtaccagcagaaacctggccaggcctcccgaggcctcctcatctatggtgcatccaccgagggcccagtcggtactcccagccctaccgtttagcggcaggtcgggtctggggacnggtagttcacgtctaccacatcagcagcctgcagtctagaagtatttgacttagtttacttacttgtaactaactagtacaatcgactcggcctctcgtacgtttcgggacgggtaacgggaccgtaaggggtcggaaagtaacgtaacgaaaaccgtacgtggtaacggtcttacggacctaaccgtacttccgttacgtttaccc

SEQ ID NO: 437147 - DNA, 521 bp, Homo sapiens
  misc_feature: GZ8MTXP02IN0LZ.39.8.A08.1.454.CMB.2.raw
  modified_base (206)..(206): a, c, t, g, unknown or other
  modified_base (333)..(333): a, c, t, g, unknown or other
  modified_base (353)..(353): a, c, t, g, unknown or other
  modified_base (392)..(392): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctntcctgtagggccagtcagagtgttagcagcaacttagcctggtaccagcagaacctggccaggttcccaggctcatcatctatggtgcatccaccagggcccatggtactcccagcctacctttagnggcaggtgggtctggggacngattcactctcacatcagcagccctgcagtctagaagtnttttgactagtttattactgtacaactagttacaaatgactggcctctctacgtttcggcggtacgggaccgtaagggtcggaagacgtacgaaaacgtacgtgtaacggctcgcaccatctagtttcc

SEQ ID NO: 437148 - DNA, 518 bp, Homo sapiens
  misc_feature: GZ8MTXP02I1YX8.39.8.A08.1.454.CMB.2.raw
  modified_base (197)..(197): a, c, t, g, unknown or other
  modified_base (206)..(206): a, c, t, g, unknown or other
  modified_base (278)..(278): a, c, t, g, unknown or other
  modified_base (290)..(290): a, c, t, g, unknown or other
  modified_base (328)..(328): a, c, t, g, unknown or other
  modified_base (345)..(345): a, c, t, g, unknown or other
  modified_base (347)..(347): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctntcctgtagggccagtcagagtgttagcagcaacttgcctggtaccagcagaacctggccaggtcccaggctnatcatcatggtncatccacgagggcccagtgtactccagcctactttagngcagtgggtctgggacngnttcactctcacatcagcagctgcagtctgaagtatttgacttagtttattactgtacaactagtaacaatcgactggcctctctacgtttcgggcggtaacgggaccgaagggtacggaagtaacgtacgaaaacgtacgtaggtggactacgacacctagtctcgtttcc

SEQ ID NO: 437149 - DNA, 529 bp, Homo sapiens
  misc_feature: GZ8MTXP02J1A4M.39.8.A08.1.454.CMB.2.raw
  modified_base (232)..(232): a, c, t, g, unknown or other
  modified_base (293)..(293): a, c, t, g, unknown or other
  modified_base (334)..(334): a, c, t, g, unknown or other
  modified_base (357)..(357): a, c, t, g, unknown or other
  modified_base (398)..(398): a, c, t, g, unknown or other
  modified_base (440)..(440): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttancagcaacttagcctggtaccagcagaacctggccaggtttccaggctcatcatctatggtncatccacgagggcccagtggactcccagcctacctttaggnggctaggtcggggtctggggacnggtgttcactctcaccatcagcagccctgcagtcagaagtntttgacttagtttatactgacactagtacaatcgatcgcctntctacgttcgggacggtagggaccgagggtcggaagactacgaaaaccgtagtggtcggtactcggacctacgtacgttctacgtttcc

SEQ ID NO: 437150 - DNA, 656 bp, Homo sapiens
  misc_feature: GZ8MTXP02JAP3N.39.8.A08.1.454.CMB.2.raw
  modified_base (197)..(197): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccaccctctcctggtacgggccagtcagagtgttagcagcaacttagcctggtaccagcaagaacctggccaggtcccaggctcatcatctagtggtgcactccacgacgggcccagtcggtaacctccccgagtcccctaaccgtttaggcggccgtagggttcggggtcgtaggggaacagggtacgtttccaactcctacacctatccgacgcgacgccctggactacgtcgtagtaaacgttgttttcggacttaagtttacgttaacgttagtactaaacgtaagtaactaaagttcgacgttcggtacccttcgttaccgttacggtttaccggggacggggtaacggggtaccggtaaggggtacgggtaaagtaacggtaaaccgaaaaccggtaacgtacgggtcggtaccgttacggaccgtaacctacgttaccgttcgtttaccc

SEQ ID NO: 437151 - DNA, 570 bp, Homo sapiens
  misc_feature: GZ8MTXP02IBLSJ.39.8.A08.1.454.CMB.2.raw
  modified_base (193)..(193): a, c, t, g, unknown or other
  modified_base (198)..(198): a, c, t, g, unknown or other
  modified_base (295)..(295): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggcctcccagatatcactggagaaatagtgatgacgcagtctccagccaccctatctgtgtctccagganaaagngccaccctctcctggtagggccagtcaggagtgtagcagcaattagcctggtaccagcagaaacctggccaggtcccaggctcatcatctagtggtncactccaccgagggccacgtggtactcccgagcctacgtttaggcgcgtaggtcggggtctggggactggacgtttcacttctcaccatcacgcagctgcagtctagtaagtatttgtcttagtttattagttcgtactaacgtagtactaatgtacgtcggtctcgttacgtacgtttcggggacgggtaacgggaccgtaagggtaggaacgaacgttacgaaaacgtacgtacggtaacggtcgtacgtaccgacctattccgttactttcc

SEQ ID NO: 437152 - DNA, 567 bp, Homo sapiens
  misc_feature: GZ8MTXP02HG2YM.39.8.A08.1.454.CMB.2.raw
  modified_base (295)..(295): a, c, t, g, unknown or other
  modified_base (366)..(366): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctctcctggtagggccagtcagagtgtagcagcaacttagcctggtaccagcaagaaacctggccaggttcccaggctcatcatctatggtncatccaccgagggcccacgttggtactccccgagccctaccgtttagtggcctaggtggggtctggggacnggtagtttcacttctccaccatcagcacgcctgcagtctagaagtattttgactagtttattactgtactaacagtacaatgactcggtcctctacgtacgtttcgggacgggtaacgggaccgtaagggtacggaagacgtaaccgaaaacggtaacgtaggtcggacgtacggaccaaccgtactaccgttacgtttcc

SEQ ID NO: 437153 - DNA, 544 bp, Homo sapiens
  misc_feature: GZ8MTXP02JUGI1.39.8.A08.1.454.CMB.2.raw
  modified_base (323)..(323): a, c, t, g, unknown or other
  modified_base (340)..(340): a, c, t, g, unknown or other
  modified_base (360)..(360): a, c, t, g, unknown or other
  modified_base (391)..(391): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagcccaccctatctgtgtctccaggagaaagcgcccaccctctcctggtacgggccagtcagagtgttagcagcaacttgcctggtaccagcaagaaacctggaccaggttcccaggctcatcatctagtgtgcatccacgacgggcccatggtacnccccagcctactttagnggcaggtgggtctggggacnggtacgtcactctcaccatcagcagcctgcngtctagaagtatttgacttagtttattacgtgtacaagtagtactaagtcgacgttcggccttctcgtacgtttcggacggtacgggtaccgagggtggaacgaactacgaaacgtaacgtggaacggtctacggccactactcgtcgttacc

SEQ ID NO: 437154 - DNA, 546 bp, Homo sapiens
  misc_feature: GZ8MTXP02GQ4LF.39.8.A08.1.454.CMB.2.raw
  modified_base (197)..(197): a, c, t, g, unknown or other
  modified_base (356)..(356): a, c, t, g, unknown or other
  modified_base (395)..(395): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagngccacctctcctgtagggccagtcagagtgttagctacaacttagcctggtaccagcagaacctggccaggtcccaggctcatcatctatggtgcatccacgacgggccacgtggtactcccagccctaacgtttagcggcaggtgggtctgggacagngttcactctacaccatcagcagcctgcagtctagaagtntttgacttagtttattactgtacaactagtaacatcgacgtggaccttctacctcgtttccggggacggtagggtaaccgagggttaggacgtaacgtacgaaaacgtaacgtggtacgggctcggactaaccctgtcgttcgttactacg

SEQ ID NO: 437155 - DNA, 549 bp, Homo sapiens
  misc_feature: GZ8MTXP02IWQ08.39.8.A08.1.454.CMB.2.raw
  modified_base (279)..(279): a, c, t, g, unknown or other
  modified_base (292)..(292): a, c, t, g, unknown or other
  modified_base (318)..(318): a, c, t, g, unknown or other
  modified_base (333)..(333): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaacctggccaggtcccaggctnatcatctatggtncactccaccagggcccacgtggtacncccagccacctttgnggctaggtgggtctggggacaggacgttcaccttctccaccatccagcagcctgcagtctagaatatttgactagtttattactgtactaacagtacaaatcgtactggccctctacgtcgtttacgggcgggtaacggaccgaaagggttggaacgtacgtaccgaaaacggtaacgttggtcggactacggaccactacgttccgttgttaccc

SEQ ID NO: 437156 - DNA, 506 bp, Homo sapiens
  misc_feature: GZ8MTXP02GB272.39.8.A08.1.454.CMB.2.raw
  modified_base (331)..(331): a, c, t, g, unknown or other
  modified_base (349)..(349): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggtcccaggctcatcatctatggtgcatccaccagggccactggtactcccagccactttagngcagtgggtctggggacngagttcactctcacatcagcagcctgcagtctgaagtattttgactagtttattactgtacaactagtaacaatgactcggcctctctactttcggcggagggaccaaggtcggacgatacgaaaacgtactgaacgctcgacaccatcgtacgttc

SEQ ID NO: 437157 - DNA, 679 bp, Homo sapiens
  misc_feature: GZ8MTXP02GQI96.39.8.A08.1.454.CMB.2.raw
  modified_base (252)..(252): a, c, t, g, unknown or other
  modified_base (291)..(291): a, c, t, g, unknown or other
  modified_base (376)..(376): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctctcctggtagggccagtcagagtgtagcagcaattagcctggtaccngcagaacctggccaggtccagctcatcatctagtggtcncactccgaccgacgggccctaacgtggtacctcccgacgcccttaaccgtttaggcggactaggggtcggggtcgtaggggaacngggtacgtttccaccttcctaccgaacctagtccgaagccaacggtccctggacgtaggttctaggtaagtttacttttggacttaaggtttttaactacgttacggtacctaaaacgtaggttaaacctaaagttcggtaaccgttcgggtacccttacttaccggttaaccggtttccgggggaaccgggtaaaccggggtaaccgtaaaggggttcggaaagtaccgttaaaaccgaaaacggtacgtttcgggaacggtacgtacggtaccgtaccctacgttccggttactttacccg

SEQ ID NO: 437158 - DNA, 594 bp, Homo sapiens
  misc_feature: GZ8MTXP02F8QOK.39.8.A08.1.454.CMB.2.raw
  modified_base (197)..(197): a, c, t, g, unknown or other
  modified_base (296)..(296): a, c, t, g, unknown or other
  modified_base (320)..(320): a, c, t, g, unknown or other
  modified_base (360)..(360): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccaccctctcctgtagggccagtcagagtgttagcagcaacttagcctggtaccagcaagaaacctggccaggttcccaggctcatcatctatggtncatccaccgaggcccagtggtacnccccagccctacgtttagcggctaggtgggtctggggacnggtacgttcacttctcaacctatcagcagcctgctgtctagtaagtatttgctagtttattacgtgtacaacgtagtaactaatacgtacgtcggtacctcgtaccttaccgtttcggggaccggggtaacggggaccggtaaaggggtacgggtaaggtaaacgttaaccgaaaaaccggtaagttaacgggtcggacccgttaggacccaacgtacttccgttcgtttaccc

SEQ ID NO: 437159 - DNA, 614 bp, Homo sapiens
  misc_feature: GZ8MTXP02HM438.39.8.A08.1.454.CMB.2.raw
  modified_base (197)..(197): a, c, t, g, unknown or other
  modified_base (293)..(293): a, c, t, g, unknown or other
  modified_base (323)..(323): a, c, t, g, unknown or other
  modified_base (369)..(369): a, c, t, g, unknown or other
  modified_base (382)..(382): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccacctctcctgtagggccagtcagagtgttagcagcaacttagcctggaccagcagaaacctggccaggttcccaggctcatcatctatggtncatcccaaccgagggccctacgtaggtacnccccgagtcccctaacgtttaggcggctaggtggggtctggggacnggacgttcactcncaccatcagcacgcctgctagtctagtaacgtagttttgacttagtttattacgttagtactaaactagtaacctaagtcggaaccgttcggtcccttacgttaccgtacggttttaccggggacggggtaacggggtaaccggtaaaggggttacggaacggtaacgtaaccgaaaacggtaacgttgggtaacggacgtacggacaccgtactaccggtttacgtttccg

SEQ ID NO: 437160 - DNA, 555 bp, Homo sapiens
  misc_feature: GZ8MTXP02GWEWY.39.8.A08.1.454.CMB.2.raw
  modified_base (294)..(294): a, c, t, g, unknown or other
  modified_base (338)..(338): a, c, t, g, unknown or other
  modified_base (357)..(357): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctctcctgtagggccagtcagagtgttagcagcaacttagcctggtaccagcagaaacctggccaggtcccaggctcatcatctagtggtncactccacgagggcccacgtggtactcccagccctactttacgngctaggtgggtctgggacnggtgttcactctcaccatcagcacgcctgctagtctagtaagttagtttgacttagtttacttacgtagtacaaactagtaacaagtcgactcggtcctactcgtacgtttcgggacgggtaacgggaccgaagggtacggaacgtacgtaacgaaaacgtacgtaggtggacgtacgacacctattccgtacgttcc

SEQ ID NO: 437161 - DNA, 678 bp, Homo sapiens
  misc_feature: GZ8MTXP02JFLDK.39.8.A08.1.454.CMB.2.raw
  modified_base (364)..(364): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggaagaaagacgcccaccctctcctggtacgggccagtcagagtgttagcagcaacttagcctaggtaccagcaagaacctggccaggttccccaggctcgatcatctagtggtcgcactcccgaaccgacgggccctacgttcggtaactccccacgtccctaacccgtttaggnggaccgtaggttcggggtcgtggggacaggtacgttccaaccttcctaccaccatcacgccacgcctagcctagttctagaacgtttatttcgacttaagttttaacttacttacgtaacctaaagtaacgttaaaccgtaaagtacgtaccgttaccgggtaccccttaccccgttaccggttttaccggggaccggggtaacgggtaacccggtaaaggggttacgggaacgtaaacgtaaaccgtaaaacgtaccgttaggtacgggtaacacggtaaccacctacggttaccttcggttacgtttaaccc

SEQ ID NO: 437162 - DNA, 650 bp, Homo sapiens
  misc_feature: GZ8MTXP02JOH5A.39.8.A08.1.454.CMB.2.raw
  modified_base (298)..(298): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggaagaaatagtgatgacgcagtctccagcccaccctatctgtgtctccaggagaaagcgccaccctctcctggtagggccagtcagagtgtagcagcaacttgcctggtaccagcaacgaacctggccacggttcccaggctcatcatctagtggtnctactcccacgacgggcccacgtggtactccccgagtaccccttacgtttaggcggtcgtagggtcgggtcgtaggggaactggtacgttcaccttcctacaccatcgacgcgacgcctgacctagttcgtaggtaaagtttacgttttgaccgttaagttttacttacgttacggttaactaaacgtaagttaacctaaagttcggtaacgtcggtaccttcgttaccgtacggtttcggggacgggtaacggggaaccgtaaggggtacggaaacgtaacgtaaccggtaaaacggtacggttggtaacgggtacttacggaccgtaaactcgttaccgttcgtttaccc

SEQ ID NO: 437163 - DNA, 578 bp, Homo sapiens
  misc_feature: GZ8MTXP02HCLB5.39.8.A08.1.454.CMB.2.raw
  modified_base (360)..(360): a, c, t, g, unknown or other
  modified_base (370)..(370): a, c, t, g, unknown or other
  modified_base (402)..(402): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctagtggtgcatccacgaggcccatggtactcccagtcctacctttaggtgctaggtcgggtctgggactaggngttcacttcncaccatcagtcacgcctgcagtctagaacgtntttgacttagtttattaccgttgtacaaactagtaactaagtcgacgtcggtacctcttccgtaccggtttcgggaccggtaacggggaaccgaaggggttacgggaaacgtactaaccggtaaaaccgtacgttagggtcggacgtcggacctaacctacgttcgttacgttacc

SEQ ID NO: 437164 - DNA, 542 bp, Homo sapiens
  misc_feature: GZ8MTXP02F83A0.39.8.A08.1.454.CMB.2.raw
  modified_base (334)..(334): a, c, t, g, unknown or other
  modified_base (352)..(352): a, c, t, g, unknown or other
  modified_base (354)..(354): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccacctctcctgtagggccagtcagagtgttagcagcaacttagcctggtaccagcagaaacctggccaggttccccaggctcatcatctatggtgcatccaccagggccactggtactcccagcctacctttagnggcaggtggtctgggacngngttcactctcacatcagcagcctgcagtctagaagtattttgctacgtttattactagtactaactagtaacgaaatgactaggtccttactcctaacgtttcgggaccggtacggggacctaaggggtaggaacgtacgtaccgaaaacggtaactggtaaggctacggcactactcgtacgtttcc

SEQ ID NO: 437165 - DNA, 639 bp, Homo sapiens
  misc_feature: GZ8MTXP02JZM8V.39.8.A08.1.454.CMB.2.raw
  modified_base (197)..(197): a, c, t, g, unknown or other
  modified_base (296)..(296): a, c, t, g, unknown or other
  modified_base (438)..(438): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccaccctctcctggtagggccagtcagagtgttagcagcaacttagcctggtaccagcagaacctggccaggttcccaggctcatcatctagtggtncactcccacgacgggcccacgtggtactccccgagtccctaaccgtttaggcggctagggttcggggtctaggggactagggtacgtttaccaccttctaccaacctatccacgcacgccctgcctagtcgtagtaaggttntttggacttaagtttattacgtagtacaaacgtagtaacaagtacgtacgttacggtcccttacgtaccgtaccggtttacggggacgggtaacggggaaccgtaaggggttacggaaacggtacgtaaaccgaaaaccggtaacggttacgggtcggtaaccgtcggaccctaaccgtacgtttaccgtacggtttaccc

SEQ ID NO: 437166 - DNA, 608 bp, Homo sapiens
  misc_feature: GZ8MTXP02HVFDV.39.8.A08.1.454.CMB.2.raw
  modified_base (295)..(295): a, c, t, g, unknown or other
  modified_base (435)..(435): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgcccaccctctcctggtagggccagtcagagttgtagcagcaacttagcctggaccagcagaaacctggccaggtcccaggctcatcatctagtggtncactcccaccgagggcccacgtggtactccccgagtccctacgtttaggcggtaccgtagggtcggggtctaggggactaggtacgttacaccttcctaccgacctatccagacacgcctagctagttctaggtaagttntttgacttagtttattcgtagttaactaaacgtagtaactaagtcgacgtcgtacccttctacgttaccggttcggggacgggtaacgggtaaccgtaaggggtacggaacgtaaacgtacgaaaacggtacgtggtaacggtctacggacctaacgtacgttcttcgttacc

SEQ ID NO: 437167 - DNA, 712 bp, Homo sapiens
  misc_feature: GZ8MTXP02G13FZ.39.8.A08.1.454.CMB.2.raw
  modified_base (302)..(302): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctctcctggtacgggccagtcagagtgttagcagctaacttgcctaggtaccagcaacgaaaccgtggccacggtcccaggcctcatcatctagtggtnctactccgaccgacgggccctacgttcggtactaccccgacgtacccctaaccgtttagggcggaccgtaggggttcgggggttccgttacgggggaaactggggttaccgtttaccaacccgtttcctacccgaaccctagttacccgaacgccgaacggtcccgttggacccgttacggttaccgttaaggtaaaacgtttagtttttacgaacctttaaaacttttaactttaaccgttacgttaaacctaaaactttaaaatttttaaacgtttacctttaacgttcccgtactttaccgtaccggttttcggggaaccggggtaacggtaaccgtaaggggtaggaagtaacgtaaccgaaaacgtacgtaggtcgactcgacctacactcgtctcttactaccg

SEQ ID NO: 437168 - DNA, 638 bp, Homo sapiens
  misc_feature: GZ8MTXP02FF48Z.39.8.A08.1.454.CMB.2.raw
  modified_base (419)..(419): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagcccacctctcctgtagggccagtcagagtgttagcagcaacttagcctggtaccagcagaaacctggccaggtcccaggctcatcatctatggtgcaccaccacggaccggacctcggtacgtaccctaccgactacccctttaacgtttacggtcgacgtaggggtcggttcggtacggaagtaggtacgtacctacttccaccaactactacgacgacnccgtccgtcgacgtacgttacgaaggttaaacgtttagtttcgaaacgttttagtttaaacttgtactaacctaaagtaaacttaactagtaccgtacgtccgtaccttccgtaacgttccgggttacgggacggggaaacgtacgggtagggtacggaaagtacaaaaccgtaaacgtacgtgggtaactcgtacgacctacgtactcgtactttacc

SEQ ID NO: 437169 - DNA, 695 bp, Homo sapiens
  misc_feature: GZ8MTXP02ITHZ2.39.8.A08.1.454.CMB.2.raw
tcagtcgcactagtcacgaccggtgctcgatttagcatactctacagggggaggaactgctcagttaggacccagacggaaccatggaagccccagcgcagcttctcttcctcctgctactctggctcccagatatcactggaagaaatagtgatgacgcagtctccagccaccctatctgtgtctccaggagaaagcgccaccctctcctggtacgggccagtcagagtgttagcagctaacttagcctggtaccagcaacgaaaccgtggccaggttcccaggctcatcatctagtggtgcactcccgaccgacggggacccacgttcggtacctccccgaacgtccccttaaccgtttaggcggacgtagggttcggggtcgtacggggacagggtacgtttccaaccttccgtaccacctatccagtccacgtcctggctagttacgtagtaacgttagttttagacttaagttttacttacgttagtaacctaaacgtaagttaactaaagtcggtaaccgttcggtcccttaccgttacggttaccggtttacgggggaccggggttaaacgggggaaaccgggttaaagggggttacggaaaggttaaaccgtaaccggaaaaacggtaccgtggggttaaccgtcgtaaccggtacccaaccgttacgttccgtttacgtttacccg

SEQ ID NO: 437170 - DNA, 561 bp, Homo sapiens
  misc_feature: GZ8MTXP02JAEJY.39.8.A08.1.454.CMB.2.raw
  modified_base (292)..(292): a, c, t, g, unknown or other
  modified_base (378)..(378): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttgcctggtaccagcagaaacctggccaggtcccaggctcatcatctatggtncatccacgagggcccagtggtactccccagtccctacgtttaggtggctaggtcggggtctggggaccaggtacgttcaccttccncaaccatcagcagccctgccagtcagtaatatttgacttagttttatactagtaccaatacgtacaaatcgaactcggtcctcgtccttacgttcgggacgggtaacgggaccgagggtacggaagtaacgtaccgaaaacgtacgttggaaggcttacgacctacccgtatcctagtttccc

SEQ ID NO: 437171 - DNA, 627 bp, Homo sapiens
  misc_feature: GZ8MTXP02IFYYX.39.8.A08.1.454.CMB.2.raw
  modified_base (305)..(305): a, c, t, g, unknown or other
  modified_base (332)..(332): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggaagaaagacgccaccctctcctggtagggccagtcagagtgttagcagctaacttagcctaggtaccagcaacgaaccgtcggacctacggtcccaggctacatcatctagtgcncactccgacgacggcctagtacgtacncccacgtccctacgtttacggcggacgtagggttcgggtcgtacgggaactaggtacgtttaccaccttcctacccacgataccgacgacgacgtccctgacgtacgttacgtagtaaagtttcgtttagactttaagttttaacttacgttagtaactaaagtacgttaacaagttcgacgtcgtccttacgtacgttaccggttacgggacgggtacggaacggtagggtacgaagtaacgtaacgaaaacgtacgtggtaacgtcgtacgtaccacttacgtcttacgttcc

SEQ ID NO: 437172 - DNA, 525 bp, Homo sapiens
  misc_feature: GZ8MTXP02IJHA1.39.8.A08.1.454.CMB.2.raw
  modified_base (292)..(292): a, c, t, g, unknown or other
  modified_base (328)..(328): a, c, t, g, unknown or other
  modified_base (344)..(344): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctgccaggtcccaggctcatcatctatggtncatccacgaggccactggtatcccagccactttagngcagtggtctgggacngattcactctcacatcagcagcctgcagtctagaatatttgctagtttattactagtactaaacagtaacaaagttgactcggcctctactacgtttcggacgggtaggaccgtaaagggtcggaaggaactacgaaaacgtaaacgtggtaacggctacggaccacctataccgtgttcc

SEQ ID NO: 437173 - DNA, 568 bp, Homo sapiens
  misc_feature: GZ8MTXP02H3P1M.39.8.A08.1.454.CMB.2.raw
  modified_base (197)..(197): a, c, t, g, unknown or other
  modified_base (293)..(293): a, c, t, g, unknown or other
  modified_base (359)..(359): a, c, t, g, unknown or other
  modified_base (371)..(371): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctctggtagggccagtcagagtgttagcagcaacttagcctggtaccagcagaaacctggccaggtcccaggctcatcatctatggtncatcccaccgacgggcccacgtgtactcccgagcctacgtttagcggctaggtgggtctggggacnggtgttcacctntaccacatcacgcacgcctgcagttactagaagttatttgcttaagtttattacgtgtacaaatagtaacatacgctacggtcctcttaccgtacgttcgggacgggtacgggtaaccgtaaggggtcggagtaacgtaaccgtaaaacgtacgttggtaacggcgtacgcctaaaccgtatttacgttacgttacc

SEQ ID NO: 437174 - DNA, 592 bp, Homo sapiens
  misc_feature: GZ8MTXP02HB03E.39.8.A08.1.454.CMB.2.raw
  modified_base (282)..(282): a, c, t, g, unknown or other
  modified_base (295)..(295): a, c, t, g, unknown or other
  modified_base (366)..(366): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagcccaccctatctgtcgtctccaggagaaagcgcccaccctctcctggtaggccagtcagagtgttagcagctaattagcctggtaccagcagaacctggccaggtcccaggctnatcatctatggtncactcccgaacgcgggcccacgtgtacctcccacgccctacgtttacgcggctaggtcgggtctggggacnggtacgttcaccttctacactatcagcacggccctggctagtactaggaacgttagttttcggacttagtttaacttactgtaactaaacgagttaactaagtagaccgtcggtacccttacgttccgttaccgtttcgggggaccggaacggggtaaccgtaggggtacgggaagaactaacgaaaacggtacgtggtcggtcacggaccactatagttcgttac

SEQ ID NO: 437175 - DNA, 556 bp, Homo sapiens
  misc_feature: GZ8MTXP02GN2HK.39.8.A08.1.454.CMB.2.raw
  modified_base (195)..(195): a, c, t, g, unknown or other
  modified_base (288)..(288): a, c, t, g, unknown or other
  modified_base (356)..(356): a, c, t, g, unknown or other
  modified_base (390)..(390): a, c, t, g, unknown or other
  modified_base (394)..(394): a, c, t, g, unknown or other
  modified_base (421)..(421): a, c, t, g, unknown or other
tcagtcgcactagtcacgaccggtgctcgatttagcatactctacagggggaggaatgctcagttaggacccagacggaaccatggaagccccagcgcagcttctcttcctcctgctactctggctcccagatatcactggagaaatagtgatgacgcagtctccagccacctatctgtgtctccaggagaaagngccacctctcctgtaggccagtcagagtgtagcagcaacttgcctggtaccagcagaaacctggccaggttcccaggctcatcatctatggtncatccaccgagggcccacgtggtactcccagccctaccgttaggtcgctaggtcgggtcgtggggacnggacgttcgactctccacatcagctacgctagcngtcnggtaattatttgactagtttattactntacgtaatagtaacaagtgtactcggcctcttctacgttcggacgggtacgggaccgaaagggtcggaagtacgtaacgtaaaacgacgttgggtcggtacgtacggaccctacctaacgtccgttacgtttccg

SEQ ID NO: 437176 - DNA, 685 bp, Homo sapiens
  misc_feature: GZ8MTXP02JKORY.39.8.A08.1.454.CMB.2.raw
  modified_base (298)..(298): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggaagaaatagtgatgacgcagtctccagccacctatctgtgtctccaggagaaagcgcccaccctctcctggtagggccagtcagagtgttagcagcaacttgcctggtaccagcaagaaacctggaccaggtcccaggctacatcatctatggtcnctactccaccgacgggccctaacgtggtactccccagtaccctaccgtttaggtcggcgtaaggttcggggtctaggggacagggtacgtttccaacgttcctaccaacctaacgtccgaaacgccgtaaacggcccgttacggacctaacggttacgttaaggtaaaggttttaacgtttttcggactttaaagtttttaaacgtttaaccttacggttaaacgtaaaaccttaacggtaaacctaaagtaccgtaaccgttacgggttccctacgttacccgttacggtttaccggggacggggtaaacggaccggtaaagggtacggaaagtactacgaaaaccgtagtcggtaacgagtacgacctacacttccgtagttacc

SEQ ID NO: 437177 - DNA, 562 bp, Homo sapiens
  misc_feature: GZ8MTXP02GVWW2.39.8.A08.1.454.CMB.2.raw
  modified_base (292)..(292): a, c, t, g, unknown or other
  modified_base (359)..(359): a, c, t, g, unknown or other
  modified_base (397)..(397): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctcaggagaaagcgccaccctctcctgtagggccagtcagagtgttagcagcaacttagcctggtaccagcagaacctggccaggtcccaggctcatcatctagtggtncatccacgagggccctagtggtactcccagtccctacgtttagcggctaggtcgggtcgtagggacnggtagttccactctaccacatcagcacgcctgcagtcngtaagttatttgacttagtttatactagtacaatagtaacatacgacgtcgtcctacgtctacgttcgggacgggtaacggtaccgaagggtaggaacggtaactaaccgaaaacgtacgtaggtaaggtaccgtacggactaaccgtacttcgttacgtttccc

SEQ ID NO: 437178 - DNA, 584 bp, Homo sapiens
  misc_feature: GZ8MTXP02F7ZEJ.39.8.A08.1.454.CMB.2.raw
  modified_base (333)..(333): a, c, t, g, unknown or other
  modified_base (344)..(344): a, c, t, g, unknown or other
  modified_base (350)..(350): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctccagatatcactggagaaatagtgatgacgcagtctccagccaccctatctgtgtctccaggagaaagagccaccctctcctgtacgggccagtcagagtgttagcagcaacttagcctggtaccagcagaaacctgccaggtcccaggctcatcatctatggtgcatccaccgagggcccactgggtactcccagcctacttagngcagtgggtcngggacngacgttcactctcaacatcagcacgcctgcagtcgtagaacgtatttgacttagtttaattacgtgtacaaagtagtaacaatcgagtcggaccttcgtacctacgtttccggggacgggtaacggggtaacccgtaaaggggttacgggtaaacggtaactaacccgtaaaaacggtaccgtacggttaacggccttacggaccctaaccacgtttaccgttacgtttccccg

SEQ ID NO: 437179 - DNA, 500 bp, Homo sapiens
  misc_feature: GZ8MTXP02FHNUK.39.8.A08.1.454.CMB.2.raw
  modified_base (354)..(354): a, c, t, g, unknown or other
tcagtcgcactagtcacgaccggtgctcgatttagcatactctacagggggaggaacttctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatcccagccacctttagtcggcagtgggtctggggacagngttcactctcaccatcagcagccctgcagtctgaagattttgctagtttattactgtacaacagtacaatgactggcctctcactttcggcggagggaccaaggtggagatcaaaacgaactgtaggcgtgcaccatctgtcttac

SEQ ID NO: 437180 - DNA, 576 bp, Homo sapiens
  misc_feature: GZ8MTXP02FHIK6.39.8.A08.1.454.CMB.2.raw
  modified_base (197)..(197): a, c, t, g, unknown or other
  modified_base (345)..(345): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtacgggccagtcagagtgttagcagctaacttagcctggtaccagcagaaacctggccaggttcccaggctcatcatctagtggtagcactccaccgaggggcccacgtggtactcccagccctacctttaggnggcaggtggggtctggggactgagttcactctacactatcaagcacgtcctgcctagtcagtaagttactttgacttagtttaacttactgtacaaacagttaaacaagttccgacgttcggccttctacgtaaccgtttcgggggaccggtaacggggaaccctaagggggtggaacgtactaacgaaaacgtaactggtcggcttcggaccaacctagtcctacgttcc

SEQ ID NO: 437181 - DNA, 594 bp, Homo sapiens
  misc_feature: GZ8MTXP02GZPKY.39.8.A08.1.454.CMB.2.raw
  modified_base (197)..(197): a, c, t, g, unknown or other
  modified_base (295)..(295): a, c, t, g, unknown or other
tcagtcgcactagtcacgaccggtgctcgatttagcatactctacagggggaggaactgatcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcaagaacctggccaggttcccaggctcatcatctagtggtncactccaccgagggcccacgtggtactccccgagcccttacctttaggcggctaggtggggtcgtgggactaggcgttcactctcacctatcaagcacgcccgtgacagttactagtaaagttattttggacttagttttaacttacttacgtacaactacgtaactaatcgtacgtcggtcccttacgtcgtaccgtttcggggacgggtaacgggaccgtaaaggggtacggaagtacgtaacgtaaaacggtaccgtaggtaacggactacggacctacctacgttccgtagttcc

SEQ ID NO: 437182 - DNA, 627 bp, Homo sapiens
  misc_feature: GZ8MTXP02J2FIU.39.8.A08.1.454.CMB.2.raw
  modified_base (192)..(192): a, c, t, g, unknown or other
  modified_base (197)..(197): a, c, t, g, unknown or other
  modified_base (206)..(206): a, c, t, g, unknown or other
  modified_base (369)..(369): a, c, t, g, unknown or other
  modified_base (429)..(429): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagcccacctatctgtgtctccagganaaagngcccacctntcctgtacgggccagtcagagtgtagcagcaacgttgcctggtaccagcagaacctggccaggtcccaggctcatcatctagtggtcacactcccgacgtacgggccctacgtggtactcccgacgtcctaccgttagcggactaggtcgggtactggggacnggacgttacactctaccacctatcaacgcaacgtccctgacctaggtctaggtaaagttnttttggacttaaggttttacttactcggtactaacgtaagtaccgtaaagtcgaccgttacggtaccctcgtttaccgtacggttaccgggggacggtaacgggtacccgaaaggggtcggaaacgttacgaaccgaaaaccggtacgttagggtaacgtaccgtacggaccctaacggtcttaccggtctttaaccc

SEQ ID NO: 437183 - DNA, 552 bp, Homo sapiens
  misc_feature: GZ8MTXP02HDN3N.39.8.A08.1.454.CMB.2.raw
  modified_base (197)..(197): a, c, t, g, unknown or other
  modified_base (293)..(293): a, c, t, g, unknown or other
  modified_base (315)..(315): a, c, t, g, unknown or other
  modified_base (332)..(332): a, c, t, g, unknown or other
  modified_base (350)..(350): a, c, t, g, unknown or other
  modified_base (352)..(352): a, c, t, g, unknown or other
  modified_base (381)..(381): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggtcccaggctcatcatctatggtncatccacagggcccatggtacncccagcctacctttagnggcaggtggtctgggacngngttcactctcaccatcagcagcctggacngtctagaattacttttgtactttagttacttgtactagctagtatgtacttacccgtggtacctcgtacgttacgtttcgggaccgtaacgggggtaccctaggggttagaaggtaaacttacgaaaacccgtagcggttcggactcggacctaccgtattcctagtttcc

SEQ ID NO: 437184 - DNA, 586 bp, Homo sapiens
  misc_feature: GZ8MTXP02JNI8B.39.8.A08.1.454.CMB.2.raw
  modified_base (197)..(197): a, c, t, g, unknown or other
  modified_base (250)..(250): a, c, t, g, unknown or other
  modified_base (300)..(300): a, c, t, g, unknown or other
  modified_base (376)..(376): a, c, t, g, unknown or other
  modified_base (431)..(431): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccacctctcctgtagggccagtcaggagtgtagcagctaatgccgtggaccngacaacgaacgtcggacctacggttcccaggctacatacatctagtggtnacactccgacggacggcctacgtggtacctcccgagtccttacgtttaggtcgacgtaggtcgggtcgagggtacnggtacgtcaaccttcaccgacctataccagcacgcctgactagttcagtaagttntttacgacttaagtttactctagtacaacgtagtaacaatcgacgtcgcctcgtacctacggtcgggacggtaacggacgtagggaggactaacgtaaccgaaaacggttctcggaagggtacccagacccgtacgtacttccggttagtttccc

SEQ ID NO: 437185 - DNA, 609 bp, Homo sapiens
  misc_feature: GZ8MTXP02IEQ4U.39.8.A08.1.454.CMB.2.raw
  modified_base (196)..(196): a, c, t, g, unknown or other
  modified_base (205)..(205): a, c, t, g, unknown or other
  modified_base (224)..(224): a, c, t, g, unknown or other
  modified_base (292)..(292): a, c, t, g, unknown or other
  modified_base (437)..(437): a, c, t, g, unknown or other
  modified_base (581)..(581): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctcaggagaaagngccaccctntcctgtagggccagtcagngtgtagcagcaacttagcctggtaccagcagaaacctggccaggttcccaggctcatcatctatggtncactccaacgagggcccagtggtactccccagcccttacctttaggcgcctagggtcggggtcttggggaacctgggtacgtttcaaccttcctaccaacccgattccgacgcgactccgtggactagttcctaggtaaacgttnttttcgacttagttttacttacgttgtaactaaacgtaagtactaaagtcgaacgttggtaccttcgtacgtaccgtttcggggacggaacgggtaccgtaaagggtgaaacggacttaacgaaaacggtcttagggaaccgtntacggactacctagttcgttacgtttcc

SEQ ID NO: 437186 - DNA, 565 bp, Homo sapiens
  misc_feature: GZ8MTXP02FH1LT.39.8.A08.1.454.CMB.2.raw
  modified_base (293)..(293): a, c, t, g, unknown or other
  modified_base (336)..(336): a, c, t, g, unknown or other
  modified_base (355)..(355): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccacctctcctgtagggccagtcagagtgttagcagcaacttagcctggtaccagcagaaacctggccaggtccccaggctcatcatctatggtncatccaccgagggcccactggtatccccagccctacctttagnggcaggtggtctggggacngagtcactctcacatcagcagcctgcagtctgaatattttgactagtttattactgtacaaacagtaacaatcgaactcggccttcgtacctaacgtttcggggacgggacggggaacccggaaagggttagggaacgaacgttaaccgaaaaacggtaaccgttagggtaaggtcccgttacggacccacctacttccgtgtttacccg

SEQ ID NO: 437187 - DNA, 608 bp, Homo sapiens
  misc_feature: GZ8MTXP02HXRXQ.39.8.A08.1.454.CMB.2.raw
  modified_base (176)..(176): a, c, t, g, unknown or other
  modified_base (192)..(192): a, c, t, g, unknown or other
  modified_base (206)..(206): a, c, t, g, unknown or other
  modified_base (300)..(300): a, c, t, g, unknown or other
  modified_base (315)..(315): a, c, t, g, unknown or other
  modified_base (322)..(322): a, c, t, g, unknown or other
  modified_base (339)..(339): a, c, t, g, unknown or other
  modified_base (358)..(358): a, c, t, g, unknown or other
  modified_base (366)..(366): a, c, t, g, unknown or other
  modified_base (370)..(370): a, c, t, g, unknown or other
  modified_base (380)..(380): a, c, t, g, unknown or other
  modified_base (393)..(393): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctccagatatcactgggaagaaatagtgatgacgcagtctccagccacctntctgtgtctcgagganaaagcgccaccctntctggtaggccagtcagtagtcgttagcagctaactagccgtaggtaccaggcaagaaaccgtgaccgtacggtcccagctcatcatctagtgngaccactacacggcnctagtcncacgcctacgtcgtagngtacgtggcgtgagacgtntacgttancctntaccactacncgactacgccgancggatcgtagaagttacttagtcgttattagtttacagttcaaacgtaatactaagtacgtacgacggttctacctaccgttaccgtttccgggtaacggggaaccggttaacggtacgggaaaggttaggaaacgttaaaccgaaaacgtttaaacccggtagggtaccgtaacgtacaaacccgtacgacgtttcgtttacgttaccgttacg

SEQ ID NO: 437188 - DNA, 666 bp, Homo sapiens
  misc_feature: GZ8MTXP02JFYVB.39.8.A08.1.454.CMB.2.raw
  modified_base (297)..(297): a, c, t, g, unknown or other
  modified_base (345)..(345): a, c, t, g, unknown or other
  modified_base (372)..(372): a, c, t, g, unknown or other
  modified_base (425)..(425): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgcccaccctctcctggtacgggccagtcagagtgtagcagcaacttgcctggtaccagcaagaacctggaccaggttcccaggctcatcatctagtggtncactccacgacggcctagtggtacctcccgatcccttaccgtttaggnggaccgtaggttcggggtcgcgggacngtacgttcacgttcaccacatcgagcacgcctggcagttctaggtaaacgttnttttacgactttaagttttaactaccgtttagtacctaaaacgtacgtaacctaagtacggtacccgtacgggtaccccttcgttaaccgttacgggtttcccggggaacgggggttaaaccggggacccggttaaagggggtacgggtaaacggtaacttaacccgtaaaaaacgggttacgttgggaacggggtacccttagggaccctaacccgtaactttccggtttcgtttaaccc

SEQ ID NO: 437189 - DNA, 600 bp, Homo sapiens
  misc_feature: GZ8MTXP02I0JM4.39.8.A08.1.454.CMB.2.raw
  modified_base (197)..(197): a, c, t, g, unknown or other
  modified_base (206)..(206): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctntcctgtaggccagtcagagtgttagcagcaacttgcctggaccagcagaacctggccaggtcccaggctcatcatatatggtgcatccacgagggcccacgtggtactcccagcctaccgtttagcggctagggtcggtctacggggactagggtcgtttcacttcctacccgtaccaagttcccacgcacgcctggctagtcgtagaagtattttgacttagtttacgttacttagttacaactagtaactaagtacgtacgtacggtcctcttccgttaccgtttacggggaccgggtaacggggtacccgtaaaggggttcgggaaagtaacgttaaccgaaaacggtaaccttaggtcgacgtcggaccaccgtacgttctcgtttaccg

SEQ ID NO: 437190 - DNA, 603 bp, Homo sapiens
  misc_feature: GZ8MTXP02HLVWF.39.8.A08.1.454.CMB.2.raw
  modified_base (294)..(294): a, c, t, g, unknown or other
  modified_base (315)..(315): a, c, t, g, unknown or other
  modified_base (334)..(334): a, c, t, g, unknown or other
  modified_base (357)..(357): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtcctccaggagaaagcgccaccctctcctgtagggccagtcagagtgttagcagcaacttagcctggtaccagcagaacctggccaggtcccaggctcatcatctagtggtncatccacgaggccatggtacncccagtccctacgtttagnggctaggtcgggtctaggggacnggtacgtttcacgtcctacaccatcacgcacgcctgctagtctagtaagttatttcgacttagttttacttacttggtactaacgtaagtaactaagtcgtacgtcggtccttacgtaccgttaccgtttcggggaaccgggtacggggtaaaccggtaaggggtacggaaacgtaacgtaaccgtaaaacggtaacgttgggtaacggtcgtacggaccgtaaccgtactttcgttacgtttacc

SEQ ID NO: 437191 - DNA, 611 bp, Homo sapiens
  misc_feature: GZ8MTXP02GAQX5.39.8.A08.1.454.CMB.2.raw
  modified_base (197)..(197): a, c, t, g, unknown or other
  modified_base (250)..(250): a, c, t, g, unknown or other
  modified_base (258)..(258): a, c, t, g, unknown or other
  modified_base (285)..(285): a, c, t, g, unknown or other
  modified_base (358)..(358): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngcccacctctcctggtagggccagtcagagtgttagcagcaattgcctggacngcagaacngccagtccagctcatcatctagtggtncactccacgacggccacgtggtacctcccgacgtccttaccgtttagcggcgtaggtcggggtctaggggacnggtacgttcaccttcctacaaccgtatccgagcctacggtccctagacctaagtcgtagtaaacgttgtttacgtacttaaggttttacttacgtcgtaactaaacgtagtaacctaattcggaccgttcggtccttacgtaccgttacggtttcgggacgggtaacggtaaccgtaaggggttaccgaaagtacgtaaccgaaaacggttgttcggaacgtcgtacgaccttacacgttcgtacgtttcccg

SEQ ID NO: 437192 - DNA, 546 bp, Homo sapiens
  misc_feature: GZ8MTXP02GT1O9.39.8.A08.1.454.CMB.2.raw
  modified_base (197)..(197): a, c, t, g, unknown or other
  modified_base (282)..(282): a, c, t, g, unknown or other
  modified_base (288)..(288): a, c, t, g, unknown or other
  modified_base (350)..(350): a, c, t, g, unknown or other
  modified_base (353)..(353): a, c, t, g, unknown or other
  modified_base (419)..(419): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctgtctgtgtctccgaggggaaangtcaccctctccttcagggccagtcagagtgttagcagcaacttagcctggtaccagcagaaacctggccaggctcccagctccnatctangatcgccctccaccgaggccactggtactcccagccaggttcagtgacagtggtctgggacngtnttcactctaccacatcagcagcctgcagtctagtaagtatttgacttagtttatacttgtactaanagtacaatcgactcggccttctccgtacgtttcgggcggtaacgggaccgtaaggggtacggaacgacgtaaccgaaaacgtaacgttgggaagtcctacggtaccaccgtacgtcgtacgtttccg

SEQ ID NO: 437193 - DNA, 606 bp, Homo sapiens
  misc_feature: GZ8MTXP02FWF3Q.39.8.A08.1.454.CMB.2.raw
  modified_base (255)..(255): a, c, t, g, unknown or other
  modified_base (299)..(299): a, c, t, g, unknown or other
  modified_base (494)..(494): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctctcctggtacgggccagtcagagtgttagcagcaacttagcctggtaccngacaagaacctggccaggtcccaggctacatcatctagtggtcncactccgaccgacgggcccagtcggtacctccccgagtccctaaccgtttgcggcctagggttcggggtacgtaggggaacctgggtacgttccgacttcctaccaccatccacgcgacgtccgtgactagtctagtaacgttatttgacttagttttacttacgtgtacaagtactactaatcgactcgccttntacgtacgttcgggacggtacggaacgtagggtacggacgtaacgtaaccgaaaacgtaccggttaggtaacggtcgtacggtacctaccctagttccggttagtttacccg

SEQ ID NO: 437194 - DNA, 638 bp, Homo sapiens
  misc_feature: GZ8MTXP02ICLLG.39.8.A08.1.454.CMB.2.raw
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtcctcgaggagaaagcgccacctctcctggtagggccagtcagtagtgtagcagctaacttagcccttggtaaccagacaacgaaacctcggcctacggtcccaggctcatctatctagtggtcgactactccaaccggacgggcccacgttggtacctccccgagtccccgtaacgtttaggcggctagggtcgggtcgtaggggaactggtaacgttcacttctccgacatcacgtcacgctgactagtctagtaacgttattttgactttagtttaactttactacgttaactaaacgtagtaactaagtcgtaacgtcggtaccttacgttcgttacggtttaccggggacggggaacgggtaacccggtaaggggtacggtaaacggtaacgtaacggtaaaacgtaacgtgggttaacgtcgtacgactaacctcgttactacgtttacc

SEQ ID NO: 437195 - DNA, 579 bp, Homo sapiens
  misc_feature: GZ8MTXP02JKV7V.39.8.A08.1.454.CMB.2.raw
  modified_base (350)..(350): a, c, t, g, unknown or other
  modified_base (358)..(358): a, c, t, g, unknown or other
  modified_base (374)..(374): a, c, t, g, unknown or other
  modified_base (381)..(381): a, c, t, g, unknown or other
  modified_base (388)..(388): a, c, t, g, unknown or other
  modified_base (407)..(407): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctggtaggccagtcagagtgttagcagcaacttgcctggtaccagcagaaacctggccaggttcccaggctcatcatctatggtgctatccacgaggcccatcggtactcccagcctacctttaagcggacagtggggttcnggggtacnggagttccaagttccncaactanctagcanccgtgacagtctgaacgtnttttgacttagtttatactggtcagtactagtactaagttcgacgttcgggtcctacggtttaccggggacctaaaacggggtaccgtaaacggtacgggtaaaactaccgtaaaacgtaccgtaggtacggtcgtaacgacgtaaccacgtcctaggttccttactaaccg

SEQ ID NO: 437196 - DNA, 711 bp, Homo sapiens
  misc_feature: GZ8MTXP02JYKIT.39.8.A08.1.454.CMB.2.raw
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagccacctatctgtgtctccaggagaaagcgcccaccctctcctggtacggccagtcagagtgtagcagctaacttgcctggtaccagcagaaaccgtggacctaggttcccaggcctcatcatctagtggtgcactccacgacgggcccacgtggtacctcccgagtccctacgtttaggcggtacgtaggttcggggtacgtaggggactacgggtcgtttaccaccttccgtaccaaccctaagtcccacgtacccgacgtcccgtcggtacctaacgttcgttaggtaaagtttacgtttttcggaactttaagggtttttaacctttaacgttaccggttaactaaaaccgtaggttaaacctaaagttccggtaaccggttcggtacccctttcgttaaccgttaccgggtttaccggggacggggtaaacggggtacccgtaaaggggtcggtaaacggtaccgtaaaccggtaaaacggtaccggttggtaacggtccgtacggacctaaccggtactttcccggtacgtttacccg

SEQ ID NO: 437197 - DNA, 604 bp, Homo sapiens
  misc_feature: GZ8MTXP02I6V71.39.8.A08.1.454.CMB.2.raw
  modified_base (144)..(144): a, c, t, g, unknown or other
  modified_base (191)..(191): a, c, t, g, unknown or other
  modified_base (206)..(206): a, c, t, g, unknown or other
  modified_base (225)..(225): a, c, t, g, unknown or other
  modified_base (231)..(231): a, c, t, g, unknown or other
  modified_base (293)..(293): a, c, t, g, unknown or other
  modified_base (297)..(297): a, c, t, g, unknown or other
  modified_base (409)..(409): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactgganaaatagtgatgacgcagtctccagccacctatctgtgtctccagganaaagacgccaccctntcctggtaggccagtcagngtgtancagctaacttgccctaggtaccagcacgaaacctggccaggttcccaggctcatcatctagnggtncaatccaaccgagggacccatggtactcccgaaacctaggttcagtggactaggtgggtctggggacaggaattcacttcacaccatccaagcagtccctggactagttacncgtagtacgttagttagtttactttacttcgtacgtacgtacgtaagtaacgtaaacgttaacgtacgtacgttcgtcgttcggttacggtacggtacggtaacggtaaacggtaaacgtaaacggtaaacggtaaacgtaaacgtaaacgtaacggtacggtaacgtacgtacgtacactacgtacgtacgtcg

SEQ ID NO: 437198 - DNA, 702 bp, Homo sapiens
  misc_feature: GZ8MTXP02JDLI5.39.8.A08.1.454.CMB.2.raw
  modified_base (309)..(309): a, c, t, g, unknown or other
  modified_base (441)..(441): a, c, t, g, unknown or other
tcagtcgcactagtcacgaccggtgctcgatttagcatactctacagggggaggaactgctcagttaggacccagacggaaccatggaagccccagcgcagcttctcttcctcctgctactctggctcccagatatcactggagaaatagtgatgacgcagtctccagcccaccctatctgtgtctccaggagaaagacgccaccctctcctggtacgggccagtcagtagtgtagcagactaacttagcctaggtaccaggacaaggaaccgtggacctacggtcccaggctacatcatctagtggtnctactaccgaacgcggaccctagtacggtactaccccgacgccttaaccgtttacggcggacgtcggtacggggttcgtaggggactaggtcgttacccacgtcctaccgaactagcacgtacgacgtcctnacggtacgtcgtacggtaaagtttagttttacgtacgtttaaagttttaaccgtttaacgttcgtaaacctaaaacgtaacgttaaacgtaaacgttacggtaccgttacgggtcccttaccgttccggtttaaccgggttcgggggtaacgggttaaacgggaaccggtaagggggtacgggaaacgtaaacgtaaacggaaaacggtaacgttagggaacggtcgttaacggcctaacctacgttaccttcggtttacc

SEQ ID NO: 437199 - DNA, 837 bp, Homo sapiens
  misc_feature: GZ8MTXP02G52KG.39.8.A08.1.454.CMB.2.raw
tcagtcgcactagtcacgaccggtgctcgatttagcatactctacagggggaggaactgctcagttaggacccagacggaaccatggaagccccagcgcagcttctcttcctcctgctactctggctcccagatatcactggaagaaatagtgatgacgcagtctccagccaccctatctgtgtctccaggagaaagacgccaccctctcctggtacgggccagtcagtagtgttagcagactaacttagcctggtaccagcaacgaaacctcggaccgtacggttcccgaggtcctacactcctaattctagtggtcgactacgtcccacggaacggggtcccctaacgttacgggtaccctaaacccccgtaaaccggtcgggtttaccgaaggggttcggggaacgttcggggttcgggggttacccggtaagggggaaactagggttaaacctttaccgtaccgtccttaacccgtaacctacgtaccgaaccgtcgtaaccggtccctacggacctaacgtttcgtacggttaaacggtttaccgtttttaggggtttaaactttttagttttcccgtaggtttaaccctaaggtaccgtttaaaagggttaaatttaaaaccggttaacggtcccggtttacccgttaccgtttccggggttacccggttttaccggggttacccggtttaaccggggaaacccggggtaaaacggggttaaaccccgtaaaagggttacgggtaaaaacctaacccggtaaaaccgtaagggtccggtaacgttacggaccggtaaactacccgtccggtttaacttcccggttttaacc

SEQ ID NO: 437200 - DNA, 531 bp, Homo sapiens
  misc_feature: GZ8MTXP02HG09C.39.8.A08.1.454.CMB.2.raw
  modified_base (199)..(199): a, c, t, g, unknown or other
  modified_base (281)..(281): a, c, t, g, unknown or other
  modified_base (292)..(292): a, c, t, g, unknown or other
  modified_base (312)..(313): a, c, t, g, unknown or other
  modified_base (339)..(339): a, c, t, g, unknown or other
  modified_base (420)..(420): a, c, t, g, unknown or other
tcagtcgcactagtcacgaccggtgctcgatttagcatactctacagggggaggaactgctcagttaggacccagacggaaccatggaagccccagcgcagcttctctttcctcctgctactctggctcccagatatcactggagaaatagtgatgacgcagtctccagcccaccctatctgtgtctccaggagaaagngccaccctctcctgtagggccagtcagagtgttagcagcaacttgcctggaccagcaagaaactggccaggttcccaggctnatcatctatgncatccacaggccatgatccnncctacttgtgcaggtggtctgggacnggtagttcactctcacatccagcaggctgcagtctgaacgtattttgacagtttaattcttgtactaaacgataactaaangtacgtcgtctactacgtacgttcgggacgggtaacgggaacgtaaaggggtcggtaaagacgtaacaaaacggagtaggtaagacgtacgactaaacctcttacgttgtc

SEQ ID NO: 437201 - DNA, 552 bp, Homo sapiens
  misc_feature: GZ8MTXP01B2VVM.13.26.C04.1.454.CMB.2.raw
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctgggggtgatcagttgttacaacggtgacacagactttgcacagagttgaggccagagtcaccctgaacccacaagacacatcccgacgaacacagcctacatggaactgaggaaatctagacatctgacgacacggggccatatattactgtgcgagaaggtacggtttggggcgcgggaactccgttcttgagtatcgttgggccgaggggaacaagtggtcaccgttctcttcgaacg

SEQ ID NO: 437202 - DNA, 546 bp, Homo sapiens
  misc_feature: GZ8MTXP01EI9M4.13.26.C04.1.454.CMB.2.raw
  modified_base (385)..(385): a, c, t, g, unknown or other
  modified_base (458)..(458): a, c, t, g, unknown or other
  modified_base (496)..(496): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgtacaacggtgacacagactttgcacagaagttgagggccagagtcaccctgaaccacngacacatccgcgaacacagcctacatggaactgaggaatctagacatctgacgacacggggccatatattacngtgcgagaggtacggtttgggcgcggaactcttcgtgngatcgttggggccgagggggaacaagtcggtcaccgttctcttcgaaccg

SEQ ID NO: 437203 - DNA, 641 bp, Homo sapiens
  misc_feature: GZ8MTXP01DTXE9.13.26.C04.1.454.CMB.2.raw
  modified_base (386)..(386): a, c, t, g, unknown or other
  modified_base (390)..(390): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttactattttcgactaactttggcatctactgggtgcgacaggcccctggccacggccttgagtcgctggggtgatcagttgttacgacggtgacacagactttgcacagtagtttgaggtcagagtcacctgaacccangacncaactccgacgaacacgacgcctacagtcggaactagaaggaaatcgttagactatcgtacgaacgaccgacgggggtacccaaatttaattactttaacgtggttcgtaccggaaaggtaacggggttaacgggtttttcgggggccggtcgggtaacctccgttcgttggttaggtacgtcggttcgggggccgttagggggaaccgtaagtcgggttctacccggttcctttaacgttccgtaaccgg

SEQ ID NO: 437204 - DNA, 722 bp, Homo sapiens
  misc_feature: GZ8MTXP01A2NTH.13.26.C04.1.454.CMB.2.raw
  modified_base (221)..(221): a, c, t, g, unknown or other
  modified_base (238)..(238): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcattcctttttcttggtggcagcggcaacaggtgtccaccctgaggttcagttggttcagtctggaggagggtgaagaagccgtggggcctnagtgcaggtcgcctgcngggcctctggttactattttcgactaacgtttggctatctacgtgggtgcgacgacggcccctggccacggcttgagtcgcgtggggtgatcagttgtacgacggtgacacgagtactttgacacgagtagtttggacggcaggacgtacgacccgtgaaacccactcgaacacactacccggcgaaacacgacgtacctacgagtacggaacgtggaaaggtaactacgttacgactaacgtccgtacgaaccggtaaccgaccgggggaacccctaattaaacgttaacgtttaacgtcggtacggtacggaaaacgggtttaacggggttaaacggggggttttttcgggggaccggtaccccggggtaacttcccgttacgttacgggacggtacgtcgggttacgggggaccggacgggggtaactacgggtaacggtacccgtaacccggttccgttaacccgttaacgtaaccccgg

SEQ ID NO: 437205 - DNA, 672 bp, Homo sapiens
  misc_feature: GZ8MTXP01AJ1QR.13.26.C04.1.454.CMB.2.raw
  modified_base (288)..(288): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctgggaggaggggtgaagagccgtggggcctcagtgcgaggtcgcctgcgagggcctcgtggttactattttcgactacgtttggctatctacgtgggtncgacaggcccctggccacggccttggagtcggcgtggggtgatcgagtttgtaacgaacggtgacacgagtactttgcacaggtaagtttggagggccaggacgtaccaccctagaaacccaacaacgaccaacactacccgacgaacacacgaccctacagtacggaactaggaacgtaactctaggactatcgtacggaacgaccgaccggggactaagttaatacgttacgtgtacggacggtaaagggtaacgggttacgggggttttcgggaccggtccggtaaccttcccgttagtcggttacggtacggtcgggttgggggccgagggggtaacgtaggtcggtacccgtaccggttccttccgttcgtaaccccgg

SEQ ID NO: 437206 - DNA, 642 bp, Homo sapiens
  misc_feature: GZ8MTXP01D03SY.13.26.C04.1.454.CMB.2.raw
  modified_base (245)..(245): a, c, t, g, unknown or other
  modified_base (421)..(421): a, c, t, g, unknown or other
  modified_base (428)..(428): a, c, t, g, unknown or other
  modified_base (442)..(442): a, c, t, g, unknown or other
  modified_base (487)..(487): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcatccttttctggtggcagcggcaacaggtgtccaccctgaggttcagttggttcagtctggaggagggtgaagagccgtggggcctcagtgcgaggtccgcctgcgagggtcctnttggttactattttcgactaactttggctatctacgtggggtcgcgacacggcccctggcccacggtcccttggagtcgcgttgggggtgattcgtaggtttcgttaacgaacgggttagaacacgtagtacctttgaccacgtaagtagttggacggcaggtacgccacccgtanaacccanaacgaccacgtacncccgacgaacacgacacctacagtacgaactaggagtaactctanacacgtcagacgacacggggactagtactattacgtgtgacggaggtagggttcgggtttgggccggtcgtaacctcgttcgttggacgtacgtcgggttacgggcgttacgggaactagtaaccggttcgccgttacgtcgttccgtaacccgg

SEQ ID NO: 437207 - DNA, 594 bp, Homo sapiens
  misc_feature: GZ8MTXP01E4QGC.13.26.C04.1.454.CMB.2.raw
  modified_base (229)..(229): a, c, t, g, unknown or other
  modified_base (280)..(280): a, c, t, g, unknown or other
  modified_base (338)..(338): a, c, t, g, unknown or other
  modified_base (366)..(366): a, c, t, g, unknown or other
  modified_base (381)..(381): a, c, t, g, unknown or other
  modified_base (386)..(386): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggctcagtgcaggtcncctgcagggctctggttacatttcgacactttggcatctactgggtgcganacggccctggccacggcttgacgtcgctggggtgatcgtagttgttacacggtgacanagactttgcacagtagttgaggccaggntcaccctgaaccacngacanactccgacaacacacgacctacagtaggaacacgaaggaactactagacatctagacgactacggggccgatatatacctgtgccgtaaggaggtacgggtttgggacggtcggaacctcgttccgtgttacgacgttcggttcggggttcgaacggggtaacgaacgtcgggtaccgtaccggttccgttaaccttaacgtaacccg

SEQ ID NO: 437208 - DNA, 623 bp, Homo sapiens
  misc_feature: GZ8MTXP02IC6U6.13.26.C04.1.454.CMB.2.raw
tcagtcacgtactacacgaccggtgctcgatttagtctagcgactttgggtttggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagaagcctgggcctcagtgtaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctacgaccacagacacactccgacgaaccacacgaccctacagacggaactggaaaggaatacgtacgaactacttacgacgaaccgaccgaccggaccaattattaacttacgtgtacgacgaaggtacggggttacggggttttggggacggtacggtacgttaccgttcgttaggagtacgtacgggtcggggaccggtagggacgtaaggtcggtacgtaccgtcttccgttacgaccgtaccccg

SEQ ID NO: 437209 - DNA, 655 bp, Homo sapiens
  misc_feature: GZ8MTXP02ITYU4.13.26.C04.1.454.CMB.2.raw
tcagtcacgtactacacgaccggtgctcgatttagtctagcgactttgggtttgggggacccaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgtaggtcgcctgcagggcctctggttacattttcgacaactttggcatctactgggtgcgacaggcccctggccacggccttgagtcgctggggtggatcagttgtttacaacggtgacacagactttgcacagaagtttgagggcagagtcaccctagaccacgacgcacactccgaccgaaccacgacgacctacagtacggaacgtaggaagtaactcgtacgaactatcgtacgaccgaacgacccgggacctaattaattactttacgtaggtacgacggaaagggtaacggggtttaacgggggttttcgggggaccggtcgggtacccgttccgttcgttaggaacgttacgtcgggttaccggggaccggacggggtaacgtaaggttcggtaccgtaccggttcttccgttaccgacggtccccg

SEQ ID NO: 437210 - DNA, 548 bp, Homo sapiens
  misc_feature: GZ8MTXP02IECIE.13.26.C04.1.454.CMB.2.raw
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgaggccagagtcaccctgaccacagacacatcccgcgaacacagccctacatgaactgaaggatctgacatctgacgacacggccatatattactgtgcgagaaggtggttttaggggcgcggactccgtcttgacgatcgtcggggtccagggggaacaagtcggtacaccgtcgtcttacgaccg

SEQ ID NO: 437211 - DNA, 530 bp, Homo sapiens
  misc_feature: GZ8MTXP02JDMK7.13.26.C04.1.454.CMB.2.raw
  modified_base (383)..(383): a, c, t, g, unknown or other
  modified_base (475)..(475): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagaagcctggggcctcagtgcaggtcgcctgcagggcctctggttacattttcgacaactttggcatctactggtgcgacaggcccctggccacggccttgagtcgcgtggggtggatcagttgtacaacggtgacacagactttgcacagaagtttgaggtccagagtcacctgaccacngacacatccgcgaaacacagcctacatgaactgagaatctgacatcagacgacacggacatactatactgtgcgagacggtaggtttcgggngtcggactcgtctgagatcgtgggccaggggaacaagtcggcacgtctcttcacg

SEQ ID NO: 437212 - DNA, 601 bp, Homo sapiens
  misc_feature: GZ8MTXP02GEZA0.13.26.C04.1.454.CMB.2.raw
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcaggttgttacaacggtgacacagactttgcacagaagttgaggccagagtcacctgaccacagacacatcccgacgaaacacacgaccctaacaatacggaaactgaaggaatctagaacatactagaaccgacacggaccatataagttactgtgacgaaggtaacgggtacgggttttagggggccgtacgggtaccgtccgttcgttacgtaggtactcggtacggggcccgaagggggtaaccaaggtacggtcgtaccgtcgtacgttaccaccg

SEQ ID NO: 437213 - DNA, 622 bp, Homo sapiens
  misc_feature: GZ8MTXP02FL4TL.13.26.C04.1.454.CMB.2.raw
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcatctactgggtgcgacaggcccctggccacggccttgacgtcgctggggtgatcagttgtacaacggtgacacagactttgcacagagtttgaggtcagacgtcaccctgaaccacagacacactcccgcgaacacacgccacaatggaaactagaggaatctagactatactgaaccgacaacggacccaatagttacttacgtgtagacgtaaggtaaacggggttacgggttttcgggggccggtacggaaccgttccgttccgttacggagtacgtccggtacgggggcccggaaagggggaacgtaaacggtcggtaccgtaccggttacctccgtttacgaacccgg

SEQ ID NO: 437214 - DNA, 708 bp, Homo sapiens
  misc_feature: GZ8MTXP02IJX2N.13.26.C04.1.454.CMB.2.raw
tcagtcacgtactacacgaccggtgctcgatttagtctagcgactttgggtttgggggacccaaaaaccacaccccctccttgggagaatcccgtagatcacagctcctcaccatggactggacctggagcatccttttcttggtggcagcggcaacaggtgtccaccctgaggttcagttggttcagtctggaggagggtgaagaagccgtggggcctcagtgcaggtcgcctgcgagggcctctggttactattttcgactaactttggctatctacgtggggtgcgacacggcccctggccacggcttgagtcgcgtggggtgatcgagttgtacaacggtgacagagactttgcacagagttggaggcagacgtcacctgaccacagacacacgtacccgacgaacacacgctacataggaatggaagataccgtagactactacgtacgaaccgaaccgaaccggacccgtaaattaacttaacgtttaaccgtacgggtacggtacgggtaaacggggttaaaacgggggtttaccgggggtttttacgggggacccggtaccgggttaaccgttcccggttaccggttaggtaacggttaacgttccggggttaccgggggacccggtaaacgggggtaaaccgtaaacgggttcgggttacccgtaacccggttccgtttaccggttaccgtaaccccgg

SEQ ID NO: 437215 - DNA, 633 bp, Homo sapiens
  misc_feature: GZ8MTXP02IPPJD.13.26.C04.1.454.CMB.2.raw
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgcctgcagggcctctggttactattttcgactactttggcatctactggggtgcgacacggcccctggccacggccttgagtcgcgtggggtggatcgagtttgtacgaacggtgacacagtactttgacacagtaagtttggaggggccagacgtcaccctgaaccacacgacacactccgacgaacacacacctaacatacgaactaggaagaactactagacatacgtagacgacgacggacctagtactattactgtgacggaaggtaacgggttacgggttttacggggcgtacgggtacttacccgttcgttacggagtacgtcggttacggggacccggtacgggggtaacgtaaggtcgggtacctaaccggttccttaccgttacgtaccccgg

SEQ ID NO: 437216 - DNA, 556 bp, Homo sapiens
  misc_feature: GZ8MTXP02GZVOS.13.26.C04.1.454.CMB.2.raw
  modified_base (384)..(384): a, c, t, g, unknown or other
  modified_base (441)..(441): a, c, t, g, unknown or other
  modified_base (454)..(454): a, c, t, g, unknown or other
  modified_base (481)..(481): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggctatctacgtgggtgcgacaggcccctggccacggccttgagtcgctggggtgatcagtttgtacaacggtgacacagactttgcacagaagttgaggccagagtcacctgaccanagacacatcccgcgaaacacagcctacatggaactgaagaatctgaacatcagacanacgcatatatacngtgcgacgaaggtacggtttggggacncggaactccgtgtacgagatcgtacggggccagggggaaccagtacggttcaaccggttctacggttacaaccgg

SEQ ID NO: 437217 - DNA, 615 bp, Homo sapiens
  misc_feature: GZ8MTXP02HQ1X2.13.26.C04.1.454.CMB.2.raw
  modified_base (348)..(348): a, c, t, g, unknown or other
  modified_base (398)..(398): a, c, t, g, unknown or other
  modified_base (494)..(494): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcgagtgcaggtcgcctgcaggggcctcgtggttactattttcgactactttggctatctactgggtgcgacaggcccctggccacgggcctttggagtcggcgtggggtggatcagtttgttacaggtnacacagtactttgcacgagtaagttggacggcgagagtcaccctgaccanagacacactcccgacgaacactacgacctacagtaggaactggaaggaatcgtagactatacgtacgacgaccgaccggacctaattatacttacngtagacgtaaggaacgggttacgggttttcgggggcgtacggtacttcccgttgttacgagtacgtcggaccggggaccgtaaggggaacgtaacgtggtactccggtctcgttacacccg

SEQ ID NO: 437218 - DNA, 693 bp, Homo sapiens
  misc_feature: GZ8MTXP02IXCN4.13.26.C04.1.454.CMB.2.raw
  modified_base (288)..(288): a, c, t, g, unknown or other
  modified_base (346)..(346): a, c, t, g, unknown or other
  modified_base (398)..(398): a, c, t, g, unknown or other
tcagtcacgtactacacgaccggtgctcgatttagtctagcgactttgggtttgggggacccaaaaaccacacccctccttgggagaatcccgtagatcacagctcctcaccatggactggacctggagcatccttttcttggtagcagcggcaacaggtgtccaccctgaggttcagttggttcagtctggaggaggggtgaagaagccgtggggcctcgagtgcgaggtcgcctgcgagggcctcgtggttactattttcgaactacttggctatctacgtgggtncgacacggcccctggccacggccttgagtcgcgtggggtgatcagttgtacgacggtnacacagtacttgacacgagtaggttgaggccagacgtccaccgtagacccanagacacacgtacccgacgaaacacacaccaacagtacggaaacgtaggaaaggtaataccgtagaactagtaccgtacgaaccggaaccgaaccgggaccctaattaaacttaacgttaacgtccggttaggacggtaacgggtaaacggggtttacgggggtttttacgggggccgggtaccggttacccgttaccgttcggttacggtagtacggtccgggtacggggtaccggaacggggtaacgtacggtacggttacccgtaaccgttccgttcctttaccgtaacccgg

SEQ ID NO: 437219 - DNA, 545 bp, Homo sapiens
  misc_feature: GZ8MTXP01DPYX7.13.38.D05.1.454.CMB.2.raw
  modified_base (236)..(236): a, c, t, g, unknown or other
  modified_base (367)..(367): a, c, t, g, unknown or other
  modified_base (502)..(502): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgttttanacagcctaccaacaataagaacttactagcttggtaccagacaagaaaccaggacagcctcctaagctgctctatttacgtgggcatctacgtccgggaagtcccggggtcccctgaccgattcagtcgcnggcgggtcgtgggacagtattcactctcacatcagcagcctgcgagctagaagtagtggggtacggcttagtttattacgtgtcagactaattattatacgtactcctcggagtcttcgtacgttcgggacgggnggttaccgaagggtagaagatacgaaactaacgttggtaacgg

SEQ ID NO: 437220 - DNA, 628 bp, Homo sapiens
  misc_feature: GZ8MTXP01C1LCJ.13.38.D05.1.454.CMB.2.raw
  modified_base (346)..(346): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaacgccccgaacctcctgatctacggtacatccactttgcacagtggatccatccaaggttcagtggcaaagtanaatctagggaaactagtacttttaccccactaacccaattccgaaggggttacctaacaacggtacccttaggtaaacgtatttttacggacgtaactttaactaatttcgtacaaactaaggtactttaacccgttcctacccccggtacgtttcggacccgtaaacgggtacccgaaagggtacgaaaagtccgaaagttacgaaacgttggtacgggcttacggccaccgtaatcccttaaggttccttacgttaactttcccgtttaacccccgtccg

SEQ ID NO: 437221 - DNA, 519 bp, Homo sapiens
  misc_feature: GZ8MTXP01DWSPO.13.38.D05.1.454.CMB.2.raw
tcagtcacgtactacacgaccggtgctcgatttagtatctgatagttgggtttggggcaggagtcagacccagtcaggacacagcatggacatgagggtcccgctcagctcctggggctcctgctgctctggctcccaagtgccaaatgtgacatccagatgacccagtctccttccaccctgtctgcgtctgtgggagacagagtcattatcacttgccggcactcagtttgtggtaggtggttgtcctggtatcagcaaaagccagggcaagcccctaaactcctgatctttgaggcgtctactttagaacgggggatctcacccaggttcagcggccagtggatctgggaacagaatcaccctcaccatcaacagcctgcagcctgaagactctgacaacttactactgtacaacagttaataatacttattactactttggaccaggggtaccaaagtggaagtaatacaaacgaacttgtggcttgcaccaatctgtctcattccttcccgtcc

SEQ ID NO: 437222 - DNA, 533 bp, Homo sapiens
  misc_feature: GZ8MTXP01B3D68.13.38.D05.1.454.CMB.2.raw
  modified_base (363)..(363): a, c, t, g, unknown or other
  modified_base (372)..(372): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgtttatacagctaccaacaataagaacttcttagcttggtaccagcaagaaaccaggacagcctcctaagctgctctatttactgggcatctagtccgggaatcccggggtccccctggaccgattcagtggcnggcgggtcngggacagtactttcactctcaccatcagcagcctgcaggctagaagagtgggtggctagtttactacgtgtcagactaatattatacgtactcctcgagcttcgtacgttcggcggttcgggaccaagggtcggaagtactacgaaacgtaacgttgtcgg

SEQ ID NO: 437223 - DNA, 525 bp, Homo sapiens
  misc_feature: GZ8MTXP01DS9UW.13.38.D05.1.454.CMB.2.raw
  modified_base (345)..(345): a, c, t, g, unknown or other
  modified_base (366)..(366): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatcccatccaaggttcagtggcaagtagntctggaaacagtatttacccncaccatcaggggtctacagcctagaagtattttgcgtacttactattgtcaaactagtacgttaccttccgtcccccggacgtttccggaccaaagggaccaaaggtggaaatcaaagcgaaacttgtaggcttgcaccaatctgtctcatcttccgcc

SEQ ID NO: 437224 - DNA, 548 bp, Homo sapiens
  misc_feature: GZ8MTXP01DM74F.13.38.D05.1.454.CMB.2.raw
  modified_base (345)..(345): a, c, t, g, unknown or other
  modified_base (367)..(367): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattggtatcagcagaagtcagggcaacgccccgaactcctgatctacggtacatccactttgcacagtggactccatccaaggttcagtgcaagtantctaggaacagtactttacccnaccatcgagggtctacagcctagaagtattttgcgtacttactatttcgtactaactagtacgtttacccttccgtcccccggtacgttccggaccgaagggtaccctaagggtacggaaataacgaagcgtaaacgttgtaggcttggcaccaatctgttcttcattccttcccgtaacc

SEQ ID NO: 437225 - DNA, 554 bp, Homo sapiens
  misc_feature: GZ8MTXP01EJC0H.13.38.D05.1.454.CMB.2.raw
  modified_base (345)..(345): a, c, t, g, unknown or other
  modified_base (369)..(369): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatcccgatccaaggttcagtggcaagtantctaggaaacagtacttttacccncaccatcagggtctacagcctagaagtattttgcgtacttactattgttacgaaactagtaacgtttaccttccgtcccccggtacgttccggtaccgaacgggtaccgaacggttaggaaagtaacgaagacggaacttagtggtacgttgcaccaactctgttctcttactccttcccgtccc

SEQ ID NO: 437226 - DNA, 618 bp, Homo sapiens
  misc_feature: GZ8MTXP01BVN0Q.13.38.D05.1.454.CMB.2.raw
  modified_base (344)..(344): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaatggtatcagcagaagtcagggcaagccccgaactcctgatctacggtacatccactttgcacagtggatcccgatcccaaggttcagtgcaagtagntctgggaaacagtacttttaccctcaccatcaggggtctacgagccctagaagtattttcgcgtaacttactatttcgtactaaacgtacggtaactttaaccccgtttccgttaccccccgggacgtttccggtacccgtaaacggggaacccgtaaacggttaacggggaaattaaccgaaaggaccggaaaccgttggtcggggtaacttcggcgaccccgtaagttcccgtttcgtttaccgttaccttacctttcccgtttccccgtcc

SEQ ID NO: 437227 - DNA, 531 bp, Homo sapiens
  misc_feature: GZ8MTXP01EWZH8.13.38.D05.1.454.CMB.2.raw
  modified_base (342)..(342): a, c, t, g, unknown or other
  modified_base (357)..(357): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgttttatacagctccaacaataagaacttcttagcttggtaccagcagaaaccaggacagcctctaagctgctcatttactgggcatctatccgggaatccggggtcccccngaccgattcagtgcnggcgggtctgggacagtatttcactctcaccatcagcagcctgcaggctgaagatggtggctagtttatactgtcagtacaaattattaatagtaacctcctccggaggtcttcgtacgtttcgggcggttagggacccaagggtggaagactacgaaacgtaacgttgtcggg

SEQ ID NO: 437228 - DNA, 586 bp, Homo sapiens
  misc_feature: GZ8MTXP01EQZ8A.13.38.D05.1.454.CMB.2.raw
  modified_base (360)..(360): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggacaagtcaagaacattggacaacttactttaaattggtatcagcagaagtcaggcaacgccccgaacctcctgactctacgtacatcctactttgcacaggtggactcccataccaagggttcaggtggacaaagtagntcgtaggaaacagtacttttacccacactatcgagggtctacagccttagaagttatttgactacttactaatttgtactaaacgtagtacgtttaacccgttccgtaccccggtacgttcggaccgaacggaaacgtaacggtaagggtaaactaagtaaacgacggtaacgttacgtaggtcgcgcacctaactcttcgttcttacttacttccgttcccgtcc

SEQ ID NO: 437229 - DNA, 616 bp, Homo sapiens
  misc_feature: GZ8MTXP01DU11C.13.38.D05.1.454.CMB.2.raw
  modified_base (195)..(195): a, c, t, g, unknown or other
  modified_base (277)..(277): a, c, t, g, unknown or other
  modified_base (342)..(342): a, c, t, g, unknown or other
tcagtcacgtactacacgaccggtgctcgatttagtatctgatagttgggtttggggagtcagtctcagtcaggacacagcatcggacatgaggtcccgctcagctcctgggctcctgctactctggctccgaggtgccagatgtgacatccagatgagccagtctccatccaccctgtcctgcgtctctcgganacagggtcaccatcacttgtcggcaagtcagaacattgacaatcttaaatggtatcagcagagtcaggcaacgccccgaacncctgactctacggtacatccaactttcgcacagtcggactccgatccaagttcagtgcaagtagntcgtaggaaacagtactttaccctcacccatcgacggggtctacgacgaccgtagaagtatttgacgtaacttaactaattcgtactaaactaggttaaacgtttacccttccggtacccccgggtacgtttccggaaccgtaacggggtacccgtaaagggtaccggtaaagtaaccgaaacgacggtaaaccgttggtaacggtcgttacggccgaaaccccgttaacgttaccgttcgttccttaccgttaccttcccgttccccgtaacc

SEQ ID NO: 437230 - DNA, 642 bp, Homo sapiens
  misc_feature: GZ8MTXP01EG36F.13.38.D05.1.454.CMB.2.raw
  modified_base (376)..(376): a, c, t, g, unknown or other
  modified_base (429)..(429): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagccgtggggggtccctcagactctcctgtgcaacctctggattcattttctctgacgcctggttgagctgggtccgccaggctcccgggagggctggagtgggtggcgtagtaaaggtagaagacatggtcggacaacacgactanagtgtcccgtaagaaaggcagattcactatctacaaagagatagaactaaaanaaaagtaatagtaattaatatactagaaactaaataacgaaacgtaaacgtaaacgaaaacgaacggaaacggaacgaacgaacggtacgtacgttaacgttaacgtaacgtaaccgaacgtaacgaggtacggacgaacgtaagttacgacgaacgtaacggaccggaaccggacggtacggttacgtaaccggttaaccgggtaaccgggg

SEQ ID NO: 437231 - DNA, 520 bp, Homo sapiens
  misc_feature: GZ8MTXP01A90M4.13.38.D05.1.454.CMB.2.raw
  modified_base (315)..(315): a, c, t, g, unknown or other
  modified_base (342)..(342): a, c, t, g, unknown or other
  modified_base (357)..(357): a, c, t, g, unknown or other
  modified_base (371)..(371): a, c, t, g, unknown or other
  modified_base (410)..(410): a, c, t, g, unknown or other
  modified_base (434)..(434): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaaacaataagaacttctagcttggaccagacagaaaccaggacagcctactaagctgctcatttacgnggcatctatccgggaatccgggtcccngacgattcagtcgcngcgggtctgggacngtatttcactctacaccatcagcagcctgcagctagaantgggtgactagtttatactgtcanataataattattactactctcgacgtcttcgtacgttcggttcggacggaccgaaggtaggaagatacgaacgtaacgttgtaagg

SEQ ID NO: 437232 - DNA, 552 bp, Homo sapiens
  misc_feature: GZ8MTXP01ES5KH.13.38.D05.1.454.CMB.2.raw
  modified_base (344)..(344): a, c, t, g, unknown or other
  modified_base (367)..(367): a, c, t, g, unknown or other
  modified_base (522)..(522): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatcccatccaaggttcagtgcaagtagntctgggaacagtacttttacccncaccatcgaggggtctacagcctagaatatttgcgtacttactattgtacaactagtacgtttacccttccgtcccccggacgttcgtaccgaacgggaccgtaacggtaggaaacgtaactaaaggacgaacgttacggtaggtcgttgcaccntactcgttctcttactccttcccgtaaccc

SEQ ID NO: 437233 - DNA, 562 bp, Homo sapiens
  misc_feature: GZ8MTXP01BS22T.13.38.D05.1.454.CMB.2.raw
  modified_base (372)..(372): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaacgccccgaactcctgatctacggtacatccactttgcacagtggatcccatccaaggttcagtggcaagtagaatctagggaacagtactttacccncaccatcgagggtctacagcctagaagtattttgacgtacttactattcgtacaaactacgtacgtttacccttccgtcccccggtacgttccgaccgaacgggtaaccgtaaacgggtacggaaacgtaacaacgacgaacgttacgtggcttggcacctaatcgtctctcttactccttcccgtaacc

SEQ ID NO: 437234 - DNA, 518 bp, Homo sapiens
  misc_feature: GZ8MTXP01BLSIR.13.38.D05.1.454.CMB.2.raw
  modified_base (236)..(236): a, c, t, g, unknown or other
  modified_base (354)..(354): a, c, t, g, unknown or other
  modified_base (407)..(407): a, c, t, g, unknown or other
  modified_base (435)..(435): a, c, t, g, unknown or other
  modified_base (478)..(478): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctcaacaataagaactctagcttggtaccagcagaaaccaggacagcctcctaagctgctcatttactgggcatctatccgggaatccggggtcccctgaccgattcagtggcngcgggtctgggacagacttcactctcaccatcagcagcctgcaggctgaaagntgggtggtcagtttattactgtcagtanaatattatagtactcctccgaggtcttcgaacgtttcggcggnggaccaagggtggaagatacgaaaacgtaacgttgtaagg

SEQ ID NO: 437235 - DNA, 610 bp, Homo sapiens
  misc_feature: GZ8MTXP01AL5SQ.13.38.D05.1.454.CMB.2.raw
  modified_base (342)..(342): a, c, t, g, unknown or other
  modified_base (366)..(366): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcaggcaagtcagaacattggcaactctttaaattggtatcagcagaagtcagggcaacgccccgaactcctgatctacggtacatccatttgcacagtggactccatcaggttcagtgacagtgntcgtaggaactagtactttacccncaccatacgagggtctacgagtccgtagtaagtatttgacgttacttacttagtttacggtactaaacgtcgttaacgtttacccttcccgtacccccgggtacgttacccgaaccgtaaccggggtaccgaaacgggtggaaacttccgaaaggtacccgaaacgttacgggtcggttaccgttcggaccctaacccgtaacttccgttacgttcccttactaaccttcccgtttaacccccg

SEQ ID NO: 437236 - DNA, 545 bp, Homo sapiens
  misc_feature: GZ8MTXP01EB76Y.13.38.D05.1.454.CMB.2.raw
  modified_base (324)..(324): a, c, t, g, unknown or other
  modified_base (375)..(375): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctaccaaacaataagaacttcttaagcttaggtaccagacaagaaacccaggacagcctacctaaagctgctctatttacgngggcatctagtaccgggaatcccggggtcccctgaccgattcgagtcggcnggcgggtctgggacagatttcactctcaccatcagcacgcctgactaggctagaagatggggtggctagtttatactgtcagactaatattatacgtctcctcgacgtcttcgtacgtttcgggacggacgggaccgtaagggtgaagatacgaaagtaacgttgtaacg

SEQ ID NO: 437237 - DNA, 527 bp, Homo sapiens
  misc_feature: GZ8MTXP01BMA9T.13.38.D05.1.454.CMB.2.raw
  modified_base (235)..(235): a, c, t, g, unknown or other
  modified_base (312)..(312): a, c, t, g, unknown or other
  modified_base (356)..(356): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgtttanacagctaccaacaataagaacttctagcttggtaccagacaagaaaccaggacagcctactaagctgctcatttacngggcatctatccgggaatccggggtcccctgacgattcagtgcngcgggtctgggacagtatttcactctcaccatcagcagcctgcaggctagaagatggggtggctagtttatactgtcagtactaatattatcgtactcctcgaggtccttcgtacgttcggacgggttacggaccgtaagggtggaagtactacgaaacgtcgttggtcgg

SEQ ID NO: 437238 - DNA, 533 bp, Homo sapiens
  misc_feature: GZ8MTXP01EQZHK.13.38.D05.1.454.CMB.2.raw
  modified_base (317)..(317): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctaccaaacaataagaacttcttagcttggtaccagcaagaaaccaggacagcctcctaagctgctacatttacgngggctatctagtccggaaagtcccggggtccccctggactgattcgaagtggcaggcgggtctggggacagtatttcactctcacatcagcagcctgcaggctagaagagtgtggctagtttatacgtgtcagctaatattatagtaacctcttcgagttctcgtacgtttcggcgggacgggtaaccaagggtgaaggacttacaaacgaagtgg

SEQ ID NO: 437239 - DNA, 759 bp, Homo sapiens
  misc_feature: GZ8MTXP01DZQQB.13.38.D05.1.454.CMB.2.raw
  modified_base (241)..(241): a, c, t, g, unknown or other
tcagtcacgtactacacgaccggtgctcgatttagtatctgatagttgggtttgggggagctacaacaggcagccaggggcagcaagatggtgttgcagacccaggtcttcatttctctgttgctctggatctctggtgcccacggggacatcgtgatgacccagtctccagactccctggctgtgtctcgtgggcgaggagggccaccatcaactgcaagtccagccagagttgttttanacagctaccaaacaataagtaacttcttagcttaggtaccagacaagaaaccaggacacgccctacctaagctcgccttactactttacgcgggactacttaccgttacggtaccggggtaaccgttcccccgggggtaccccctacggtaaccgtattccgaggtcgggacgaacgggggtccgggttacgtacggggaactacggttactttccaaccttcctaccaacctataccgacgaccgaacgtccctaggaccgaggtacgtaaggaaagtgttgggggtacgggtaaccttttaaggttttaacttacgtacggtaacctaaagtaacttaaaatttaactttaacgttaaccggttacccttaaccccggttaccgggacgggttacccttaccggttaacggggttttcccgggggaaccgggggttaacggggttaacccggtaaagggggttaggaaacggtaaaccttaaccgggaaaaccggttaaccggttgggtaaccggg

SEQ ID NO: 437240 - DNA, 553 bp, Homo sapiens
  misc_feature: GZ8MTXP01DLG15.13.38.D05.1.454.CMB.2.raw
  modified_base (345)..(345): a, c, t, g, unknown or other
  modified_base (528)..(528): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcacatcacttgtcgggcaagtcagaacattggacaactcttaaattggtatcagcagaagtcagggcaacgccccgaactcctgatctacggtacatccactttgcacagtggactccatccaaggttcagtgcaagtagntcgtaggaaactagtactttaccctcaccatcgagggtctacgagtcctagtaagtatttgacgtacttacttattacgtacaactagtaacgtttacccttccgtacccccggtacgttccggaccgtaacgggaccgtaaagggtacgaaagtaacaagcgtaacgttgtaggcttgcacntctgttcttacttcttcccgctaac

SEQ ID NO: 437241 - DNA, 576 bp, Homo sapiens
  misc_feature: GZ8MTXP01AZBOP.13.38.D05.1.454.CMB.2.raw
  modified_base (351)..(351): a, c, t, g, unknown or other
  modified_base (376)..(376): a, c, t, g, unknown or other
  modified_base (409)..(409): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagagtcagggcaacgccccgaactcctgactcgtacggtacatccactttgcacagtcggactcccatcccgaaggttcagtggacaagttantcgtaggaaactagtactttacccnctaccatcgagggtctacgagtacctagaagtntttcgacgttacttactattcgtacaaactagtaacgtttacccgttccgtcccccggacgttccggaccgaacgggtaaccgaacggtaggaaactaacgaaacgacgaacttacggtcggacgttgcttaccaacttctcgttctcttacttccgttcccgtccc

SEQ ID NO: 437242 - DNA, 653 bp, Homo sapiens
  misc_feature: GZ8MTXP01CJCRF.13.38.D05.1.454.CMB.2.raw
  modified_base (355)..(355): a, c, t, g, unknown or other
  modified_base (381)..(381): a, c, t, g, unknown or other
  modified_base (599)..(599): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcaagaacattggacaacttactttaaatggtatcagcagaagtcgaggacaacgccccgaactctgatcgtacggtacatcctactttgcacgagtcggactcccatcccgaaggttcaggtgcaagtantactagggaaactagtacctttaccncacctagtacgagggtactacgacgacctagtaagttatttggacttaacttaacttattacgtactaaacgtagttaacgttacccgtttacccgtcccccggtacgtttccggaacccgtaaaggggtaccctaaagggttacggaaaacgttaaccgaaaacggttccggtaaaaccgttgggtaaccggggtcttacgggcccttaaacccgtntttacccgtttcggttaccctttcgaaccctttcccggtttcccccgtaacccg

SEQ ID NO: 437243 - DNA, 580 bp, Homo sapiens
  misc_feature: GZ8MTXP01DNIOS.13.38.D05.1.454.CMB.2.raw
  modified_base (239)..(239): a, c, t, g, unknown or other
  modified_base (330)..(330): a, c, t, g, unknown or other
  modified_base (391)..(391): a, c, t, g, unknown or other
  modified_base (433)..(433): a, c, t, g, unknown or other
  modified_base (458)..(458): a, c, t, g, unknown or other
  modified_base (483)..(483): a, c, t, g, unknown or other
  modified_base (516)..(516): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactcccctggctgtgtctctgggcgagaggccaccatcaactgcaagtccagccagagttgttttanacagcctaccaaactaataagtacttctagcttggtaccagacaagaaaccaggacacgccctacctaagctcgtccttactaatttacgngggtcattctacgtaccgggaacgtccccggggtccccctagaccgtattcgaggtcgcgngggtccgggtcgtaggggacaggttactttcactctacaccntcagctagcctagcgagctaggaangttgggtcggtattaagtttatacngttacagataattattagtactctaaccgtcgngtccttacgtcgttcgggacggttggaaccgaagggtggaataagccgaaaagtcgttaaggcg

SEQ ID NO: 437244 - DNA, 603 bp, Homo sapiens
  misc_feature: GZ8MTXP01EGF4T.13.38.D05.1.454.CMB.2.raw
  modified_base (366)..(366): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctttctgcgtctctcggagacagggtcaccatcacttgtcgggcaagtcagaacattggcaactctttaaattggtatcagcagaagtcagggcaagccccgaactcctgatctacggtacatccactttgcacagtggatccatcaacgttcagtgcagtaagatctaggaacagtacttttacccncaccatcgagggtactacagcctgaaagtattttgcgtacttactattagtacaacgtagtacgtttaacccttccgtacccccggtacgtttccggaccgtaaacggggacccgtaaaggggttacggaaacgtacgaaacggacgaaaccgtgttacgggtcgttacggaccgacccttaacgttccttcggttcctttacctaactttcccgtttccccgttccgtttaacccg

SEQ ID NO: 437245 - DNA, 573 bp, Homo sapiens
  misc_feature: GZ8MTXP01AP2ZX.13.38.D05.1.454.CMB.2.raw
  modified_base (347)..(347): a, c, t, g, unknown or other
  modified_base (369)..(369): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagaagtcagggcaacggccccgaactcctgactctacggtacatccactttgcacagtggactcccatccgaaggttcagtggcaagtantctggaactagtactttacccnaccatcagggtctacagtcctagagtatttgacgttacttactattcgtacaactagtacgttacccttacccgttccccggtacgttaccggacccgaacggggtaacccgaaaggtacgggaaataacgaaagttacggaaacgttcggtaggtacttcggccacctaactcgtcgtccttacttcttccgttccccgtccc

SEQ ID NO: 437246 - DNA, 614 bp, Homo sapiens
  misc_feature: GZ8MTXP01D724V.13.38.D05.1.454.CMB.2.raw
tcagtcacgtactacacgaccggtgctcgatttagtatctgatagttgggtttgggggagtcagtctcagtcaggacacagcatggacatgagggtccccgctcagctccgtggggctcctgctactctggctccgaggtgccagatgtgacatccagatgagccagtctccatccaccctgtctgcgtctctcggagacgagggtcaccatcacttggtcgggcaagtcaagaactattggactaacttactttaaattggtatcagacagaaccccgtgacgggacaacgaccccgaacctcctgactctacgtacactcctactttcgacacgaggtggactacccataccgaaggttcaggtgacaagtagtgtactaggtaactagtaactttacccactacctatacgacgggtactaacgacgtacctaggtaagttagttttacgacgttacttacttattcgtactaaactacgtaccgtttacccttcccgtccccggtacgttccggtaccgaacgggtaacgaacggtaggaataacgaaagacgaacgttaggtcggtcgttcgcacctaatcgtcttcttcttacttccttcccgtaacc

SEQ ID NO: 437247 - DNA, 527 bp, Homo sapiens
  misc_feature: GZ8MTXP01D8D2B.13.38.D05.1.454.CMB.2.raw
  modified_base (345)..(345): a, c, t, g, unknown or other
  modified_base (365)..(365): a, c, t, g, unknown or other
  modified_base (503)..(503): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaacgccccgaactcctgatctacggtacatccactttgcacagtggactcccatccaaggttcagtgcaagtantctggaacagtactttaccnctacatcgagggtactacagcctagaagtatttgacgtacttactattcgtacaaactagtacgttaccttccgtccccggacgttcggaccgtaacgggaccaaggtcggaaatcgaagcgaacttgtgcttgcacntctgtctcacttccttccgtaacc

SEQ ID NO: 437248 - DNA, 571 bp, Homo sapiens
  misc_feature: GZ8MTXP01ENVHG.13.38.D05.1.454.CMB.2.raw
  modified_base (239)..(239): a, c, t, g, unknown or other
  modified_base (326)..(326): a, c, t, g, unknown or other
  modified_base (397)..(397): a, c, t, g, unknown or other
  modified_base (501)..(501): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgtttanacagctaccaaacaataaagtaacttcttaagcttaggtaccagacaagaaaccaggacagcctcctaaagctgctactatttacgngggactatctacgtccggggaaactcccgggggtccccctggaccgtattcgaggtcggcaaggcgggtcngggacagtactttcaactctacaccatcacgcacgcctgacgaggctagaaagtatggggtggtactagtttactactgtcagtacaatatatagtctcctcgngtcttcgtacgttcggcggttacgggaccgaagggtggaacgtaactacgaaaccgtaagttcgtaacgg

SEQ ID NO: 437249 - DNA, 538 bp, Homo sapiens
  misc_feature: GZ8MTXP01C2U2J.13.38.D05.1.454.CMB.2.raw
  modified_base (237)..(237): a, c, t, g, unknown or other
  modified_base (351)..(351): a, c, t, g, unknown or other
  modified_base (359)..(359): a, c, t, g, unknown or other
  modified_base (369)..(369): a, c, t, g, unknown or other
  modified_base (375)..(375): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctaccaacaataagaacttctagcttggtaccagacaagaaaccaggacacgcctcctaagctgctacatttactgggcatctatccgggaatccggggtcccctgacgntcagtgcnggcgggtcgngggacngatttcactctcaccatcagcagcctgcaggctggaagatggggtggtctaagtttactactgtacagactaattacttatacgtactcctcgaggtccttgtacgttcggacgggttcggaccgaaggtcggaagacgtacgaaagtaaccgttggtaacgg

SEQ ID NO: 437250 - DNA, 606 bp, Homo sapiens
  misc_feature: GZ8MTXP01C81J9.13.38.D05.1.454.CMB.2.raw
  modified_base (560)..(560): a, c, t, g, unknown or other
  modified_base (573)..(573): a, c, t, g, unknown or other
tcagtcacgtactacacgaccggtgctcgatttagtatctgatagttgggtttgggggagtcagtctcagtcaggacacagcatggacatgagggtccccgctcagctccgtggggctcctgctactctggctccgaggtgccagatgtgacatccagatgagccagtctccatccaccctgtctgcgtctcgtcggagacagggtcaccatcacgttgtcgggcaagtcaagaacattggactaactactttaaatggtatcagcaagaagtcgaagggacaacgccccgtaaacctcctagactacgtaacggtacacttccctaatttgaccaacgtaggtacgggactccccgaattacccgaaaggtttcaaggtcggataaagtagaatactagggaaactagtacttttaccacacctatcgtagggactacagtcctaggaattatttgacttacttatattacgaactaatacgtacgtttacccttaccgtccccggacgttacgaccgaacggacgtaacggaagaaagtaacaaggacgaaacgttgnggtcacggccacnctacgtcttactcttacttccgttcccgtaacc

SEQ ID NO: 437251 - DNA, 573 bp, Homo sapiens
  misc_feature: GZ8MTXP01BTHNR.13.38.D05.1.454.CMB.2.raw
  modified_base (350)..(350): a, c, t, g, unknown or other
  modified_base (375)..(375): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaagccccgaacctcctgatctacggtacatccactttgcacagtggactcccatccaaggttcaggtggcaagtagntctagggaaacagtacttttacccncaccatcgaggggtcaacagcctaggaagtattttagcgtacttactattcgtacaaactagtacgttaccgtttcctcccccggtacggttccgaccgaacgggtaccgaagggtacggaaagtaacgaagacggaaacgttcggtaggtcgttcggccaccaacttcgtcgttcttcacttccgttcccgtaaccc

SEQ ID NO: 437252 - DNA, 639 bp, Homo sapiens
  misc_feature: GZ8MTXP01D0O3L.13.38.D05.1.454.CMB.2.raw
  modified_base (372)..(372): a, c, t, g, unknown or other
tcagtcacgtactacacgaccggtgctcgatttagtatctgatagttggggtttggggggagtcagtctcagtcaggacacagcatggacatgagggtccccgctcagctcctggggctcctgctactctggctccgaggtgccagatgtgacatccagatgagcagtctccatccaccctgtctgcgtctcgtcggagacgagggtcacatcacgttggtcgggcaagtcaagaacagttggactaaacttctttaaatggtatcagacagaagtacgagggaccaacgccccgaacctcctagactcgtacgtacatcctactttgactacgagtcggactcccatccgaaggttcaggtgacaagtagntcgtaaggaacagttactttaccctcaaccagtacgagggtctagagtacctagtaagttattcggactacttacgtattacgtactaacttaacggtacctttaacccgttcccgtacccccggtagttaccggaacccgtaacgggaaacccgtaaagggtaacggaaacgaacggtaaacgacggtaaacgttcggacggtacggttcacgttaccctaattcttccggttacttcgttaccctaaccgttttccccgtaaccc

SEQ ID NO: 437253 - DNA, 527 bp, Homo sapiens
  misc_feature: GZ8MTXP01BKYRG.13.38.D05.1.454.CMB.2.raw
  modified_base (360)..(360): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacgggacatcgtgatgacccagtctccagactccctggctgtgtctctggcgagaggccaccatcaactgcaagtccagccagagtgttttatacagctaccaaacaataagaacttcttagcttggtaccagacaagaaaccaggacagccctcctaagctgctcatttactgggcatctatccggaatccggggtccccctggacgattcagtggcnggcgggtctggggacagtattcactctacaccatcagcagcctgcgagctagaagatgggtcggtctagttttattaactgtcagactaatattatagtactctcgagcttcgacgtttcggcggttgggaccaagggtgaagatacgaaacgtaacgttgtaacgg

SEQ ID NO: 437254 - DNA, 601 bp, Homo sapiens
  misc_feature: GZ8MTXP01DD2AR.13.38.D05.1.454.CMB.2.raw
  modified_base (201)..(201): a, c, t, g, unknown or other
  modified_base (332)..(332): a, c, t, g, unknown or other
tcagtcacgtactacacgaccggtgctcgatttagtatctgatagttgggtttgggggcaggagtcagacccagtcaggacacagcatggacatgagggtccccgctcagctcctggggctcctgctgctctggctcccaagtgccaaatgtgacatccagatgacccagtctccttccaccctgtctgcgtctgtggganacagagtcattatcacttgccggcactctagtttgttgggtaggttggttgtcctggtatcagcaaaagccagggcaacgcccctaaactcctgatctttgaggcgtctacgtttaggaacgggggtatcncaccagttcagcgccaggtgatcgtgggaacagtaacttccaaccctcaccatacaaactacgcctgcacggcctagaacgactctagactaaacttactactacgtacaaacagttaaacttaaattaactttaattaactacgttttcggaccgtaggggtaacctaaaggtggaagtaattaacgaaaacgtacgttagttacggcttacggccttaaccctaatccgttcgttcctttacttaacttccctttccccggtaaccc

SEQ ID NO: 437255 - DNA, 546 bp, Homo sapiens
  misc_feature: GZ8MTXP01BGVD0.13.38.D05.1.454.CMB.2.raw
  modified_base (319)..(319): a, c, t, g, unknown or other
  modified_base (348)..(348): a, c, t, g, unknown or other
  modified_base (352)..(352): a, c, t, g, unknown or other
  modified_base (360)..(361): a, c, t, g, unknown or other
  modified_base (415)..(415): a, c, t, g, unknown or other
  modified_base (447)..(447): a, c, t, g, unknown or other
  modified_base (516)..(516): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagactccctggctgtgtctctgggcgagagggccaccatcaactgacaagtccagccagagttgttttatacagctacaaacaataagacttctagcttaggaccagacaagaaaccaggacagcctacctaagctgctacatttacngggacatctagccggatccggggtccccngacntcagtcgnngcgggtctgggacagattcactctacacatcagcagcctgcgaggctagaaagngtggggtggtacttagtttacgttatgtacanactaattattaatacgtcctaaccgtacgagtccttcgtaacgttcgggacggttcgggacgtaagggnggaagtatacgaaacgtaagttggtaacgg

SEQ ID NO: 437256 - DNA, 550 bp, Homo sapiens
  misc_feature: GZ8MTXP01AVQRK.13.38.D05.1.454.CMB.2.raw
  modified_base (316)..(316): a, c, t, g, unknown or other
  modified_base (345)..(345): a, c, t, g, unknown or other
  modified_base (359)..(359): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctaccaaacaataagaacttcttagcttggtaccagcaagaaaccaggacagcctacctaagctgctcatttacnggcatctatccgggaatccggggtccccngacgattcagtgcnggcgggtctgggacagtactttcactctcaccatcagcagcctgcaggctaggaagagtgggtggtctagtttatacgtgttcagactaaattattataagtcctccgtcggacggtccttcgtacgtttccgggacgggttacgggaccgtaaagggtggaagagtaccgaaacggtaacgttgggtcgg

SEQ ID NO: 437257 - DNA, 560 bp, Homo sapiens
  misc_feature: GZ8MTXP01DOTK1.13.38.D05.1.454.CMB.2.raw
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaggtgtccagtgtgaggtgcaagtggtggagtcgtgggggggcttggttaagcctgggggtcctcagactctcctgtgcaacctctggattcattttctctgacgcctggttgagctgggtccgccaggctcccgggaagggctggagtgggtggccgtattaaaggtagaagacagtggtcggacaacagactacagtcgtcccgtagaaaggcagattcactatctcaagagatgactacaaaagaaatagatatatctagacaaatgaaacaacctagaaaagcgaaggacacgaggacgtgtagttactgtaaccaacagatgggaccagattagcaaaagtggaccgcgacgagttcgaacgttaacggtaaccggggg

SEQ ID NO: 437258 - DNA, 620 bp, Homo sapiens
  misc_feature: GZ8MTXP01DLOVH.13.38.D05.1.454.CMB.2.raw
  modified_base (343)..(343): a, c, t, g, unknown or other
  modified_base (367)..(367): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaatggtatcagcagaagtcagggcaacgccccgaactcctgatctacggtacatccactttgcacagtggatccatccaaggttcagtgcaagtagntctaggaactagtacttttacccncaccatcaggggtctacacgcctagaagtatttgacgtacttacttattgtacaaacgtacgtaacgtttaccccttccgtaccccccgggaacgtttccggtacccggaaacgggtaaacccggtaaacggttaacgggaaacgttaacgaaacgttaacggtaaaccgttaggtacggtcgttacggccgaacccgtaaactcttaaccggttcctttaccgttaccttccctttaacccccggttccccg

SEQ ID NO: 437259 - DNA, 521 bp, Homo sapiens
  misc_feature: GZ8MTXP01EMFVN.13.38.D05.1.454.CMB.2.raw
  modified_base (235)..(235): a, c, t, g, unknown or other
  modified_base (258)..(258): a, c, t, g, unknown or other
  modified_base (311)..(311): a, c, t, g, unknown or other
  modified_base (346)..(346): a, c, t, g, unknown or other
  modified_base (354)..(355): a, c, t, g, unknown or other
  modified_base (363)..(363): a, c, t, g, unknown or other
  modified_base (397)..(397): a, c, t, g, unknown or other
  modified_base (436)..(436): a, c, t, g, unknown or other
  modified_base (442)..(442): a, c, t, g, unknown or other
  modified_base (477)..(477): a, c, t, g, unknown or other
  modified_base (493)..(493): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgtttanacagctaccaacaataagacttntagcttaggtaccagcaagaaaccaggacagcctactaagctgctcatttacngggcatctagtcggaactccggggtcccctgacgnttcagtgnnggcggtcngggacagtattcactctcaccatcagcacgcctncaggctagaagatgggtggctagtttatactgtacaganaaattntatagtactcgtcgagcttcgtacttcgggccggnggaccgaaggtggaanaacgtacaaaccgtaacgttggtaacgg

SEQ ID NO: 437260 - DNA, 585 bp, Homo sapiens
  misc_feature: GZ8MTXP01EBZ6F.13.38.D05.1.454.CMB.2.raw
  modified_base (238)..(238): a, c, t, g, unknown or other
  modified_base (326)..(326): a, c, t, g, unknown or other
  modified_base (381)..(381): a, c, t, g, unknown or other
  modified_base (384)..(384): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagcctaccaaacaataagaacttcttagcttaggtaccagacaacgaaaccaggacagccctcctaaagctgctactactttacgngggacattctagtccggggaatcccgggggtcccctggacgtatcgaggtggcgnggngggtccgtagggactaggtactttcactctcacctatcagcacgcctgccaggctagaaagtgtgggtggtctaagtttattacgtgtcagtactaattattaattacgtacctccgtacgacggtcttcgtacggtttcgggacgggttacgggaaccgtaagggtaggaacgactacgaaaccgtaacgttggtaacgg

SEQ ID NO: 437261 - DNA, 546 bp, Homo sapiens
  misc_feature: GZ8MTXP01EQFII.13.38.D05.1.454.CMB.2.raw
  modified_base (352)..(352): a, c, t, g, unknown or other
  modified_base (376)..(376): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaacgccccgaactcctgactctacggtacatcctactttgctacagtggatcccatccaaggttcaggtgcaaagtagntctaggaaactagtactttacccncaccatcgagggtctacagcctagtagtatttgacgtacttactattgtacaactagtacttaccttccgtccccggtacgtcgaccgacggtaaccgaaggtacggaaataactaacgacgaacgttgtagcgttcgcacaactctcgtctcttatccttccgtaaccc

SEQ ID NO: 437262 - DNA, 650 bp, Homo sapiens
  misc_feature: GZ8MTXP01AJ8F7.13.38.D05.1.454.CMB.2.raw
  modified_base (223)..(223): a, c, t, g, unknown or other
  modified_base (357)..(357): a, c, t, g, unknown or other
  modified_base (381)..(381): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggnaagtcagaacattggacaacttctttaaattggtatcagcagaagtcagggcaagccccgaactcctgactctacggtacatccactttgcacgagtgggactcccatcccgaaggttcaggtggcaaagtagntcgtaggaacagtacttttacccncaccatcgagggtctacgagcctagaacgtatttcgacgttacttaactattcgtacgtaactagtaccgtttacccgttcccgtacccccgggtacgttccggaacccggtaaaccggggtaaccggtaacgggtaacgggtaaacgtaacgaaacgggttaccgtaaacgttcgggttacgggccgttaccgggccttaaacccgtaacgttcccgttcggtttacccttcccgttaccctttcccgtttccccccggttaaccccg

SEQ ID NO: 437263 - DNA, 584 bp, Homo sapiens
  misc_feature: GZ8MTXP01A6ML4.13.38.D05.1.454.CMB.2.raw
  modified_base (238)..(238): a, c, t, g, unknown or other
  modified_base (249)..(249): a, c, t, g, unknown or other
  modified_base (358)..(358): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgtttanacagctacaanaataagaacttctagcttggtaccagcaagaaaccaggacagcctctaagctgctcatttacgtgggcatctagtcggggaatccggggtcccctgacgattcagtgcnggcggtctgggacagtattcactctcacatcagcagcctgcgaggctagaagtacgtggggtcggtacgttaaggtttacttaccgtgtcctaagaccttaaattaatttaagttacggttacctcccgtaccggttagggtccttaccgtacggtttccggggacggggttacgggaaccgtaaggggtgaacggacgttaccgaaaacgtaacgttggtaacgg

SEQ ID NO: 437264 - DNA, 577 bp, Homo sapiens
  misc_feature: GZ8MTXP01EBRBE.13.38.D05.1.454.CMB.2.raw
  modified_base (344)..(344): a, c, t, g, unknown or other
  modified_base (368)..(368): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattgcaactcttaaatggtatcagcagaagtcagggcaacgccccgaactcctgatcgtacgtacatccactttgcacagtggactcccatccaaggttcagtggcaaagtagntctagggaacagtacttttacccncaccatcgagggtctacagtcctagtaacgtatttgacgtacttactattcgtacaactacgtacgttacccttaccgtccccggtagtaccgtaccgaacggtaccgaacggtaacggtaaacgtaacgaaacgaccgtaaacgttcggtacggtcgttacgttcgacctaacgtactcgttcttcttacttccgttcccgtaacccg

SEQ ID NO: 437265 - DNA, 553 bp, Homo sapiens
  misc_feature: GZ8MTXP01AUSG7.13.38.D05.1.454.CMB.2.raw
  modified_base (237)..(237): a, c, t, g, unknown or other
  modified_base (315)..(315): a, c, t, g, unknown or other
  modified_base (364)..(364): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgttttanacagctaccaaacaataagaacttctagcttggtaccagcagaaaccaggacagccctactaagctgctctatttacngggcatctagtcggggaactccggggtcccctggacgtattcgagtgcnggcgggtctgggacagtatttcactctcaccatcagcagcctgcaggctagaagtatggggtgtactagtttattacgtgtcagtactaatagttatacgtcctcctccgaggtcttcgtaacgtttcgggacgggacgggacccgtaaggggtcggaagacgtaccgaaacggtaacgttggtaacgg

SEQ ID NO: 437266 - DNA, 571 bp, Homo sapiens
  misc_feature: GZ8MTXP01C9ELA.13.38.D05.1.454.CMB.2.raw
  modified_base (356)..(356): a, c, t, g, unknown or other
  modified_base (382)..(382): a, c, t, g, unknown or other
  modified_base (533)..(533): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggactaactctttaaattggtatcagcagaagtcagggcaacgccccgaacctcctgactctacggtacatccactttgcacgagtggactcccataccgaaggttcagtggacaagttagntcgtaggaaactagtactttaccccnctaaccatcgagggtctacgagtcctagaacgttatttacgacgtacttaacttattacgtacaactagtaacgtttaccctccgtaccccggacgttcggaccgtaagggaccaaggtacgaaataacgaaagcgtaaacttggtacggnttacgcacctgtactgtctcttactccttcccgtaacc

SEQ ID NO: 437267 - DNA, 554 bp, Homo sapiens
  misc_feature: GZ8MTXP01AB9OY.13.38.D05.1.454.CMB.2.raw
  modified_base (347)..(347): a, c, t, g, unknown or other
  modified_base (372)..(372): a, c, t, g, unknown or other
  modified_base (404)..(404): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggcaactctttaaattggtatcagcagaagtcagggcaacgccccgaactcctgatctacggtacatccactttgcacagtggactccatccaaggttcagtgcaagtagntcgtaggaactagtacttttacccncaaccatcaggggtctacgagcctagaacgtnttttagcgtacttactattgactaacagtacgttaccttccgtccccggacgttccggaccgaaacgggtaccgaagggtacgaagtaacgaagacgtaaacgttggtacggcgttgcttaccaatctgtcttcttactccttcccgtcc

SEQ ID NO: 437268 - DNA, 602 bp, Homo sapiens
  misc_feature: GZ8MTXP01DXLY8.13.38.D05.1.454.CMB.2.raw
  modified_base (348)..(348): a, c, t, g, unknown or other
  modified_base (372)..(372): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggacaactctttaaattggtatcagcagaagtcagggcaacgccccgaactcctgatctacggtacatccatttgcacagtggactcccatccaaggttcagtgcaagtagntctgggaaactagtactttacccncaccatcgaggggtctacagcctagaagtatttgcgtacttactattcgtacaaactagtacgtttaccttccgtacccccggtagtttccggaacccgtaacgggaaccgtaaacgggtacggtaaacgtaacgtaaacggacgtaaaccgttaggttcggtcgttacggccttaaccgtaacttacttcggtttccttccttaactttccctttccccggttaacccc

SEQ ID NO: 437269 - DNA, 574 bp, Homo sapiens
  misc_feature: GZ8MTXP01DM7TF.13.38.D05.1.454.CMB.2.raw
  modified_base (307)..(307): a, c, t, g, unknown or other
  modified_base (386)..(386): a, c, t, g, unknown or other
  modified_base (494)..(494): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagcgtggagttttcctacggctgctatttaaaaggtgtccagtgtgaggtgcaagtggtggagtcgtggggggggcttggttaagcctggggggtccctgagactctcctgtgcagcctctgggttcaccgtcagtcacacctacatgagctgggtccnccaggctccgaggggagggctgggagtgcgtcttctttttattatagttagtggtagtacatactcgcagactccgtgngggggccattcaccatctccagagacaacttccaagaacacgcttgtttactcaaaatgaaacagccctagggacgagacccgatgacgacgccgtgtattatgtggngaagagaggtcgggaccgacgtaacgttacgttacgttcgtaagtaggtcggtcggtcgggacggaacggaaccgtaacg

SEQ ID NO: 437270 - DNA, 545 bp, Homo sapiens
  misc_feature: GZ8MTXP01DJ7U4.13.38.D05.1.454.CMB.2.raw
  modified_base (368)..(368): a, c, t, g, unknown or other
  modified_base (505)..(505): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaattggtatcagcagaagtcagggcaagccccgaactcctgatctacggtacatccacttttgcacagtggatccatcccaaggttcagtggcaagtagaatctgggaaacagattttacccncacccatcaggggtctacagcctagaagtattttgcgtacttactattgtcaaactagtacgtttaacccttctacccccgggacgtttccggccaaaggggtacccaaagggtagaaaagttcaaagcgtaaaccnggttaggccttggcaccaatctgtcttcatcttccgaacc

SEQ ID NO: 437271 - DNA, 632 bp, Homo sapiens
  misc_feature: GZ8MTXP01BDNEC.13.38.D05.1.454.CMB.2.raw
  modified_base (311)..(311): a, c, t, g, unknown or other
  modified_base (347)..(347): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggcaagtcagaacattggacaacttctttaaatggtatcagcagaagtcagggcaacgccccaactcctgatctacgtacactccatttgcanagtggactcccatccaaggttcaggtgacaagtagngtcgtagggaaactacgttacttttaccccacaaccctacgtacgtacgggggttctaacgacgtaccgttaggtaaacgttattttacgggaccgttactttaacttagtttacgtactaaaacgtaggttaaccgtttaacccctttcccgtaccccccgggtacgtttacccggaaccggtaaacgggaacccgtaaagggacggtaaacgtaacgaaacgacggtaaacttggtacggtcttcgccacctaactcgtcgttcttcacttccttcccgtaac

SEQ ID NO: 437272 - DNA, 821 bp, Homo sapiens
  misc_feature: GZ8MTXP01BU9IM.13.38.D05.1.454.CMB.2.raw
  modified_base (241)..(241): a, c, t, g, unknown or other
  modified_base (322)..(322): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagacctccctggctgtgtctcgtgggcgagaggccaccatcaactgcaagtccagccagtagttgtttanacagctacaaacaataagaacttctagcttaggtaccagacaagaaaccaggacagccctacaagctgctactatttacgngggactagtcgtaacgtccggggaaacgtccccgggggtccccctacggacgtactttccgaaggttcgggacctaagggccggggttacgttacgggggaacctaagggttaacttttccaaaccttcccttaccaaccctacgttaccgaaacggtcctaaaccggccccgttaggaccccggtaagggaccccggttaaagggaaaacgggttacggtttgggggttaacgggggttaaccctttttaaaggggtttttaaactttaaacccggttgggttaacctaaagggttaacccttaaaacgtttaaacttttaaggtttaaacccggtttaccctttaaccccggttaacccgggttaaacggggttcccttaaccggttaacccgggttttccgggggaaccggggaacggggttaaaccccggtaagggggtttacggaacgggtaaacttaacccggaaaaacgggttaaccgtttgggtaaccggg

SEQ ID NO: 437273 - DNA, 586 bp, Homo sapiens
  misc_feature: GZ8MTXP01DMLY2.13.38.D05.1.454.CMB.2.raw
  modified_base (347)..(347): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaacgccccgaactcctgactctacggtacatccactttgcacagtggactccatccaaggttcagtcgcaagtagntctagggaaacagtactttaccctcaacctatcgagggtctacgagtcctagaagtatttgctaacttactattcgtacaaactagtacgttacccttccgtcccccggtacgttccggaccgaacgggtaccaaagggtgggaaatccgaaaggttccgaaacgttcggtacggcgttacggttccaaccctaagttacccttggttcccttcttaacgttccccttcccgtaacccc

SEQ ID NO: 437274 - DNA, 559 bp, Homo sapiens
  misc_feature: GZ8MTXP01DENZH.13.38.D05.1.454.CMB.2.raw
  modified_base (221)..(221): a, c, t, g, unknown or other
  modified_base (347)..(347): a, c, t, g, unknown or other
  modified_base (528)..(528): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggnaagtcagaacattggcaactctttaaattggtatcagcagaagtcagggcaacgccccgaacctcctgatctacggtacatccactttgcacagtcggatcccatcaaggttcagtggcaagttgntctaggaactagtactttaccctcaaccctatcgaggggtctaacagccctagtaagtattttaggacctactttaactattactacgaactagtacgtttaaccctccttcccccggagttcggaccgaacggaccaaggtacgggaaataacaagacgaaacgttcgtagggcttcggnacccaatcctgtcttcactcttaacccgtcc

SEQ ID NO: 437275 - DNA, 561 bp, Homo sapiens
  misc_feature: GZ8MTXP01BFFS6.13.38.D05.1.454.CMB.2.raw
  modified_base (342)..(342): a, c, t, g, unknown or other
  modified_base (365)..(365): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcggcaagtcagaacattggcaatcttaaatggtatcagcagaagtcagggcaagccccgaactcctgatctacggtacatccactttgcacagtggatcccatccaaggttcagtgcaagtagntctggaaacagtacttttacccnctaaccatcgaggggtctacgagcctagaacgttattttgacgtacttactattgtacaacgtagtacgtttacccttccgtcccccggtacgtccggtaccgaacgggtaccgtaacggtaggaaactaacgaacgagaaccttggtcggcgttggcacctaactctgttccttcttacttccttcccgtaaccc

SEQ ID NO: 437276 - DNA, 665 bp, Homo sapiens
  misc_feature: GZ8MTXP01D2DY0.13.38.D05.1.454.CMB.2.raw
  modified_base (350)..(350): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaacttctttaaattggtatcagcagaagtcaggcaacgccccgaactcctgatctacgtacatcctactttgcacagtcggactcccataccgaggttcagtgcaagtacgntactaggaactagtactttaccccacaccctagtacgaggggtacctaacgacgtccgttaagtaagttagtttttacgaccgtaacctttaataactttacgaactaaacgtacgtaaccgttttaccccttcccgttaccccccgggtacgttaccggtacccggaaacgggtaaccggtaaacgggtaaacgggtaaacgttaaacggaaacggaccggtaaaccgttggtaacgggtcgttaccgccgttaaacccgtaacttccggttaacgtttactaccgttacctttccccttccccggttaacccg

SEQ ID NO: 437277 - DNA, 578 bp, Homo sapiens
  misc_feature: GZ8MTXP01EKFGE.13.38.D05.1.454.CMB.2.raw
  modified_base (347)..(347): a, c, t, g, unknown or other
  modified_base (370)..(370): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaatcttaaatggtatcagcagaagtcagggcaacgccccgaactctgatctacgtacatcctactttcgcacgagtcggactcccatccaaggttcagtggcaagtagntctaggaacagtacttttacccncaccatcgagggtctacgagcctagaagtatttgcgtacttacttattcgtacgaaactagtacgtttacccttccgtcccccgggtacgtttaccggacccgtaaacgggtacccgaaagggtacggaaagtcgaaacgacggtaaacgttcggtaggtcgttcgcaccgtaatcttcgttcttacttacttccgttcccgtaaccc

SEQ ID NO: 437278 - DNA, 485 bp, Homo sapiens
  misc_feature: GZ8MTXP01EM9JO.13.38.D05.1.454.CMB.2.raw
  modified_base (372)..(372): a, c, t, g, unknown or other
  modified_base (389)..(389): a, c, t, g, unknown or other
  modified_base (392)..(392): a, c, t, g, unknown or other
  modified_base (398)..(398): a, c, t, g, unknown or other
  modified_base (407)..(407): a, c, t, g, unknown or other
  modified_base (412)..(412): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (452)..(452): a, c, t, g, unknown or other
  modified_base (459)..(460): a, c, t, g, unknown or other
  modified_base (462)..(462): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaaagtcagaacattggcaactcttaaatggtatcagcagaagtcagggcaagccccgaactcctgatctacggtacaatccactttgacacagtgggactcccatccaaggttcaagtggcaagtagaatctagggaacagattttacccnaccatcaggggtcacancanatatgntactatatntacanatatactcctccgcgtcgcgacgagagagaanaanaananagagagnngnacaatctctctcttactcttctc

SEQ ID NO: 437279 - DNA, 613 bp, Homo sapiens
  misc_feature: GZ8MTXP01DFKNK.13.38.D05.1.454.CMB.2.raw
  modified_base (336)..(336): a, c, t, g, unknown or other
  modified_base (347)..(347): a, c, t, g, unknown or other
  modified_base (371)..(371): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattggtatcagcagaagtcagggcaacgccccgaacctcctgatctacggtacatcctatttgcacgagtggatcccatccaaggttnagtgcaagtantcgtggaaactagtactttacccncacatcgagggtctacgagacctagaagtatttgacgtacttactattcgtactaacgtagtaacgtttacccttcccgtcccccggtacggttccggacccgtaaaggggtaaccccaaagggttacggaaaattaaccgaaaacggttaccggaaaccgttggtacgggtaccgttaggccaaacccgtaattacccgttggttccctttaccttaactttcccgtttccccggtaaccc

SEQ ID NO: 437280 - DNA, 709 bp, Homo sapiens
  misc_feature: GZ8MTXP01C9WGJ.13.38.D05.1.454.CMB.2.raw
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgttttaacagcctaccaaacaataagtaacttcttagcttggtaccagacaagaaaccaggacacgaccctactaacgctgcctactattttacgtcgggtacattaccttaagtcccgtaggtaaaccgttccccccgggggtacccctacggtacccgtacgtttccgaaagggttcgggccgtagggtccggggtacgttacggggacctaggtactttccaccttctaccacctatcgaacgctacgccctggaccacggctaagagtaggttggtagggttacttaaggtttaacttcgtcgttacgaacgtaacctaaatttaacttaacgttaacggttaaccctacccgttaccggtaacggttccttaccgttacggtttaccggggacggggttaaaccggggtaaccggtaaaggggttaaccgggtaaggtaacgttaaccggtaaaaccgttaaggttccggg

SEQ ID NO: 437281 - DNA, 527 bp, Homo sapiens
  misc_feature: GZ8MTXP01BS872.13.38.D05.1.454.CMB.2.raw
  modified_base (370)..(370): a, c, t, g, unknown or other
  modified_base (380)..(380): a, c, t, g, unknown or other
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctccgtggaggacagtcacactcacttgtggcttgagatacggctcagtctctagtagttactaccccagctggtaccaacacgaccccaggccaggctccgcgcacgctcatctacaacacaaacactcgctcttctgggtccctcatcgctctctgcctcatccgtggaacaaanctgcccttancatcgacggggccaggacagaagatgaatctagtatttattacttgttgtttctttatagttggtagtgtcctatttctgtctggtgttcgggaggcgcgacccggcgttcgaccgtccgtcggtcacgccgaacggcttcgccccg

SEQ ID NO: 437282 - DNA, 646 bp, Homo sapiens
  misc_feature: GZ8MTXP01B5TND.13.38.D05.1.454.CMB.2.raw
  modified_base (449)..(449): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttgggtaagccgtgggggtccctcagactctcctgtgctaacctctggattctattttctctgacgcctggttgagcgtgggtcccgccgaggccgtcccggggaaggggctgggagtggggttcggaccgttaagttaaaggagaaaggacagtggtacggacaacacgactacgagtcgttcccgaagaaagcaagtatcgactatctacaaagagtatgaacctanaaaaaagaatagaatatatctagacaaatcgaaacaactaaggaaaacgcgaaagaccagaggtcgtagtaacttactacgtaacccaagacggagtacggggacctaaagggaacttacggacgttaaaacgtcgggggaccccgaacggtaaaccggtcggtttacccgaaccggtttccgggtaacccgggggg

SEQ ID NO: 437283 - DNA, 628 bp, Homo sapiens
  misc_feature: GZ8MTXP01E043G.13.38.D05.1.454.CMB.2.raw
  modified_base (387)..(387): a, c, t, g, unknown or other
  modified_base (406)..(406): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttggtcgggcaagtcaagaacattggacaactctttaaattggtatcagcagaagtcagggcaacgccccgaactcctagactctacggtacactccaactttcgcacgaggtgggactcccatccaagggttcaggtggagtaagatcgtaggaaactagtacttttacccncacctatcgaggggtctanacgctagaagtatttagacgtacttactattcgtacaacgagtaacgtttacccttccgtaccccggtagtccggaccgaacgggaacccgtaaggttacggaaattacgaaacggtcgaaacggtcggttagggtacgtccgggttacgacccgttaacgtttcccttcggtttccgttaccgttaccttaccctttaacccccgggttcccttaacccgg

SEQ ID NO: 437284 - DNA, 567 bp, Homo sapiens
  misc_feature: GZ8MTXP01C16T2.13.38.D05.1.454.CMB.2.raw
  modified_base (343)..(343): a, c, t, g, unknown or other
  modified_base (364)..(364): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactcttaaattggtatcagcagaagtcagggcaacgccccgaactcctgatctacggtacatccactttgcacagtggatccatccaggttcagtgcaagtantctggaactagtactttaccncaccatcgagggtctacgagtcctagaagtatttgcgtacttactattcgtactaaactagttacctttaccttccgtacccccgggtacgtttccggacccgtaaggggaacccgtaaagggtacggaaacgtaacgaacgacgtaaaccgttggtacgggcttcggcacctaatctcgttctcttactccttcccgtaacc

SEQ ID NO: 437285 - DNA, 596 bp, Homo sapiens
  misc_feature: GZ8MTXP01ALOSC.13.38.D05.1.454.CMB.2.raw
  modified_base (318)..(318): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgtttatacagctaccaaacaataagaacttctaagcttggtaccagacaagaaaccaggacagcctactaagctgctcatttacgngctatctacgtccggacgtccggtccctgacgtatcgagtcgcgcggtcgggtcgtagggactagtacttcactctacacatcacgcacgcctgcgaggtacgtagaagtagtcgggtcgtacgttagtttaacttacgtgtacacgtaactaaattattaacgtaccgttacctccgtaccggttacgtccgttacgttaccggttcgggacgggttaacgggaccggtaaggggtacgaacggtaacgtaaccgttaaacgtaacgttcggtaacg

SEQ ID NO: 437286 - DNA, 574 bp, Homo sapiens
  misc_feature: GZ8MTXP01B6RW6.13.38.D05.1.454.CMB.2.raw
  modified_base (236)..(236): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctggcgagaggccaccatcaactgcaagtccagccagtagtgtttanacagctacaaacaataagaacttctagcttaggtaccagacaagaaaccaggacagacctccaagctgctactatttacgtgggctatactacgtaccgggaatcccggggtcccctggactgtacttcgaaggtcgcgacggtcggggtcgtagggacagtacttcactctacacatcagcagcctgcgagctagaagtagtggtggtactagtttatcgtgtcagtataattagttatacgtaacctcccgttacggtagttccttacgtacgtttccgggcgggaacgggaaccgtaagggtaacggaagacttaacgaaacgttaacgttcggg

SEQ ID NO: 437287 - DNA, 594 bp, Homo sapiens
  misc_feature: GZ8MTXP01DEGZR.13.38.D05.1.454.CMB.2.raw
  modified_base (239)..(239): a, c, t, g, unknown or other
  modified_base (323)..(323): a, c, t, g, unknown or other
  modified_base (371)..(371): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgttttanacagcctacaaacaataagaacttcttagcttaggtaccagacaagaaaccaggacagccctacctaagctgctctatttacgngggcatctagtccgggatcccggggtcccctgacgattcgagtcggcnggcgggtctgggacagtatttcactctcacatcagcagcctgcgaggctaggaaagagttggggtacggtacttaagttttacttaacgtggtctagtaactaattaattactaacgtccctaaccgtcggttacggtcttacgtaacggtttcgggacggggacgggttaaccgtaagggttacggaagtaacgtacgttaaaacgtaaccgttggtaacgg

SEQ ID NO: 437288 - DNA, 582 bp, Homo sapiens
  misc_feature: GZ8MTXP01CQEXP.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaactcctgactctacggtacatccactttgcacgagtggatcccataccgaaggttcagtggacaaggtagaatcgtagggaactagtactttacccacaccatcgagggtctacgacgctagaacgttatttcgacgtacttactagttagtactaactacgtactttaccccgttccgtcccccggacgtttccggaccgaacgggtaacccgaagggtacggaaataacgaaacggcgtaaacgttgtacggcttcggcaccgtaatccttgtccttacgactccgtttccccgaacc

SEQ ID NO: 437289 - DNA, 633 bp, Homo sapiens
  misc_feature: GZ8MTXP01C8CTD.13.38.D05.1.454.CMB.2.raw
  modified_base (352)..(352): a, c, t, g, unknown or other
  modified_base (374)..(374): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcaagaacattggacaactcttaaatggtatcagcagaagtcagggcaacgccccgaactcctgatctacgtacatcctatttgacacgagtggactcccgatcccaaggttcagtggacaagttagntcaggaaacagtactttacccncaccatcgagggtactagacgtccgtagtaagtagttttcgacgtactttaactatttacgtactaaactaacgtaacgtttaaccccttccgttaccccccggtaggtttaccggaaccgtaaacgggaacccgtaaagggttacggaaaagttaaccgaaaaggcccggtaaaacgttggttaaacggcgttacggttccgaacccgtaagtaccttcggttcctttaccttaacgtttcccgttccccgttaaccc

SEQ ID NO: 437290 - DNA, 729 bp, Homo sapiens
  misc_feature: GZ8MTXP01DS6O6.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcaagaacattggacaaacttctttaaattggtatcagcagaagtcgagggacaacggccccgaacctcctagactctacggtaacacttcctactttgacacgtagtgggactcccaattccgaaaggttcaaggtcggaccgtaaaaggttacgtaacgtacgtacgggtaaactaacggtaacctttttaccccacgtaaccctaagttaccgtaagggggttaccttaacgaacgtacccgttaaggtaaagttacgttttacgacgttaaacctttaacttaagtttacgttaacgtaaacgttaacggttaaccgttttaaccccgttcccgttaccccccgggtaccggtttaccgggaacccgtaaacggggtaacccgtaaagggttacggaaaacgttaaccgaaacggaccgtaaacgttaggtacggtcgttacggaccttaccgtaacttcttaaccgttctttaccttactttccccttaaccccgtccc

SEQ ID NO: 437291 - DNA, 504 bp, Homo sapiens
  misc_feature: GZ8MTXP01DKS5S.13.38.D05.1.454.CMB.2.raw
  modified_base (237)..(237): a, c, t, g, unknown or other
  modified_base (351)..(351): a, c, t, g, unknown or other
  modified_base (358)..(358): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctcaacaataagaactctagcttggtaccagcagaaaccagacagcctcctaagctgctcatttactgggcatctatccgggaatccggggtcccctgacgatcagtgcngcgggtntgggacagatttcactctcaccatcagcagcctgcaggctgaagatggtgctagtttatactgtcagacaatattatagtaactcctcgaggtcttcacgtttcggcggagggaccgaaggtggaagatacaaacgaacttgtcgg

SEQ ID NO: 437292 - DNA, 526 bp, Homo sapiens
  misc_feature: GZ8MTXP01AG7N4.13.38.D05.1.454.CMB.2.raw
  modified_base (235)..(235): a, c, t, g, unknown or other
  modified_base (309)..(309): a, c, t, g, unknown or other
  modified_base (356)..(356): a, c, t, g, unknown or other
  modified_base (414)..(414): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgtttanacagctccaacaataagaacttctagcttggtaccagcagaaaccaggacagcctcctaagctgctcatttacngggcatctatccgggaatccggggtccccctgaccgattcagtggcngcgggtctgggacagatttcactctcaccagtcagcagcctgcaggctaggaagtagnggtggtctagtttattatgtcagtacaatattaatgtactcctcgaggcttcgtacgtttcggcggttaggacccgaaaggtggaagactacgaaacgtaacgttgtaacgg

SEQ ID NO: 437293 - DNA, 692 bp, Homo sapiens
  misc_feature: GZ8MTXP01BVK44.13.38.D05.1.454.CMB.2.raw
  modified_base (228)..(228): a, c, t, g, unknown or other
  modified_base (239)..(239): a, c, t, g, unknown or other
  modified_base (297)..(297): a, c, t, g, unknown or other
  modified_base (396)..(396): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctcgtcggagacgagggtccaccatcacttggtcgganaagtcagaacngttggacaacttctttaaattggtatcagcagaagtcagggcaacgccccgaactccngatctacggtacatcctactttgcacgagtgggactcccgataccaaggttcaaggtggtaagtaagatcgtagggaaactacgttaacttttaccccncaacctagtacgaggggtacctacgacgtacctagtaaagttagttttcgaccgttaacttacttatttacgtaccaaacggtaggttaaccgtttaccccttaccccggtacccccggtaaccggttccggacccggtaaacggggtaaccgtaaacgggtaacgggtaaaacgttaccgaaacggtaccggttaaacgttcggttaacgggtccgttcggttaccacccgttacttccggtttacgttccctttaccgtacctttccccgtttcccccggttccgtttaacccg

SEQ ID NO: 437294 - DNA, 565 bp, Homo sapiens
  misc_feature: GZ8MTXP01D2QJR.13.38.D05.1.454.CMB.2.raw
  modified_base (198)..(198): a, c, t, g, unknown or other
  modified_base (359)..(359): a, c, t, g, unknown or other
  modified_base (383)..(383): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcgganacagggtcaccatcacttgtcggcaagtcaagaacattggacaacttactttaaatggtatcagcagaagtcgagggacaacgccccgaacctcctgactcgtacgtacactcctatttcgacacgagtggactcccatccaaggttcagtggacaagtangtctaggaactagtactttacccncacactcgagggtcacagcctagagttatttcgacgttacttaactattacgtactaactagttaccgttacccttcccgtcccccggagttccggacccgaacggtaaccgtaaggtacgaagtaacgaacgacgacgttgtagtcgttacgcgacctgtctcttctcttactcgttctcg

SEQ ID NO: 437295 - DNA, 600 bp, Homo sapiens
  misc_feature: GZ8MTXP01AQN0U.13.38.D05.1.454.CMB.2.raw
  modified_base (232)..(232): a, c, t, g, unknown or other
  modified_base (345)..(345): a, c, t, g, unknown or other
  modified_base (369)..(369): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacnttgcaactctttaaatggtatcagcagagtcagggcaacgccccgaactcctgactctacggtacatccactttgcacagtcggatcccatccaaggttcaggtgcaagtagntctagggaacagtacttttacccncaccatcgacgggtctacgagccctagaagttatttgacgtacttactattacgactaactacgtaacgttacccgttccgtacccccggtacgttacccggtaccgaaacgggaaccgtaaacggtaacggaaacgtaacgaaaggacgtaaacgttcggtacggtacttcggacccacgtaacgttcgttaacgtttcccttcttaaccttcctttccccggtaacccg

SEQ ID NO: 437296 - DNA, 679 bp, Homo sapiens
  misc_feature: GZ8MTXP01BEBYM.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctctcggagacgagggtccaccatcacgttggtcgggacaagtcaagtaacagttggactaacttactttaaagttggtaatcagacaagaagtcgacgggacaaccgaccccgacctcctagactcgtaccggtacacgtcctactttgactacgagtggactcccataccgaaggttcagtcgactaagtagcgtacgtagggaaactacgtactttaccccgactactagtacgtagggtacctacgacgtacctaggtaagttactttcggacttacttactattacgtactaacgtacgttaccgtttacccgttcccgtaccccggtaccggttaccgacccggtaacgggaaccgtaacggtacggtaaacgtaacgaacggttacgtaaaccggttgttacggacgttaccggccgttaacctaacgtcggtttccgtttacttaccgttcccgtttaaccccgtttaaccccgtaacccg

SEQ ID NO: 437297 - DNA, 584 bp, Homo sapiens
  misc_feature: GZ8MTXP01EV9CD.13.38.D05.1.454.CMB.2.raw
  modified_base (288)..(288): a, c, t, g, unknown or other
  modified_base (349)..(349): a, c, t, g, unknown or other
  modified_base (372)..(372): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaaacattggcaactctttaaattggtatcagcagaagtcagggcaagccccgaactccngatctacgtacatccatttcgcacagtggatcccgatccaaaggttcaagtggcaagtagntctaggaacagtacttttacccncaccatcgaggggtctaacgagtacccgtagaaaggtatttcgacgtactttaacttaagtttcgtactaaacgtaagtaacgtttacccttaccgtccccccggacgtttccggaccgtaacggaacccgtaaaggtacggaaataacgaaacgacgaaacgttgtacgcgttagcaccaatcgtcttacttcttactccttccgtaaccc

SEQ ID NO: 437298 - DNA, 512 bp, Homo sapiens
  misc_feature: GZ8MTXP01A90IH.13.38.D05.1.454.CMB.2.raw
  modified_base (367)..(367): a, c, t, g, unknown or other
  modified_base (480)..(480): a, c, t, g, unknown or other
  modified_base (486)..(486): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaacctcctgatctacggtacatccactttgcacagtggatcccatccaaggttcagtggcaagtagaatctggaacagattttacccncaccatcaggggtctacagcctagaagattttgcgacttacatttgcaacagagttacccttctcccccggagttcgccaacggtccgaaggtggaaagtcaaagcgaaacgngtggcngcacaatctgtctcactcgttcccgc

SEQ ID NO: 437299 - DNA, 601 bp, Homo sapiens
  misc_feature: GZ8MTXP01BLYXU.13.38.D05.1.454.CMB.2.raw
  modified_base (245)..(245): a, c, t, g, unknown or other
  modified_base (314)..(314): a, c, t, g, unknown or other
  modified_base (403)..(403): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggacgggccaccatcaactgacaagtccagccagtagttgtttanacagctacaaactaataagtaacttctagcttaggaccagacaagaaaccaggacacgccctacgtaanctgacttactatttacgcgggctaagttcgtaacggtaccgggaacgtcccgggggtaccccctggaaccgtattccgaggtcggacgngggtcggtcgtagggactagtacttcacttctacaccatcagctacgcctgaccgtaggactagaaagtgtggggaggttacttagtttactactgtactagtaactaagttattaacgttacgtacctccgtcgagtccttcgtaacggttcgggacgggacgacgaaggtagaactacgaacgttaacgtgttgcg

SEQ ID NO: 437300 - DNA, 609 bp, Homo sapiens
  misc_feature: GZ8MTXP01AIHI4.13.38.D05.1.454.CMB.2.raw
  modified_base (369)..(369): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcacatcacttggtcgggacaagtcaagaactagttggactaacttctttaaattggtatcagcagagtcagggcaacgccccgaacctcctagactcgtacggtacactccatttcgacacgagtcgggactcccagtaccaaggttcaggtggactaaagtagntcgtagggaaactacgtacttttacccgacacctatcgagggtacacagacctagaagtattcgacgtacttactattgtaactaactagtacgttacccttccgtaccccgggtacgttccggaccggaacgggtaaccgtaagggtaacggaacgtaacgaacgacgtaaacgttggtacggcgttacggttcaccgtaactcggtcgttccttacttccttcccttcccggtaaccc

SEQ ID NO: 437301 - DNA, 543 bp, Homo sapiens
  misc_feature: GZ8MTXP01B53LA.13.38.D05.1.454.CMB.2.raw
  modified_base (240)..(240): a, c, t, g, unknown or other
  modified_base (317)..(317): a, c, t, g, unknown or other
  modified_base (346)..(346): a, c, t, g, unknown or other
  modified_base (359)..(359): a, c, t, g, unknown or other
  modified_base (367)..(367): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgttttanacagctaccaacaataagaacttctagcttggtaccagacaagaaaccaggacagcctactaagctgctcatttacngggcatctagtccggaatccgggtccccngacgatcagtgcnggcggtcngggacagtacttcactctcacatcagcacgcctgcgagctagaagtatgggtgtacttaagtttactacgtgttacagtactaaattattaagtacgtacctccgtacgaggtcttcgtacgttcgggacgggacggttaccgaagggtcgaagatacgaaacgtaacgttggtcg

SEQ ID NO: 437302 - DNA, 653 bp, Homo sapiens
  misc_feature: GZ8MTXP01C0DWX.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtcaccatcacttggtcgggcaagtcaagaactattggactaacttactttaaattggtatcagcaagagtcgagggcaacgccccgaacctcctagactctaacggtacactcctactttgcacgtagtcggactccataccgtaaggttcaggtggcaaagtagctcgtaggaactagtactttacccacacctatcgacgggtactacgacgtccgtagtaagttagtttcggaccttaacttacttacgttacgtaactaaacgtacggttaacgtttaccccgttaccgtaccccccggtacggttacccggtaaccggaacgggtaacccgtaaagggtaacggaaacgtaacgtaaacggaccgtaaacgttcggtacggtcttacggttccacccgtaacttccttcggttcccttacttaccttccccgttcccgtaaccc

SEQ ID NO: 437303 - DNA, 624 bp, Homo sapiens
  misc_feature: GZ8MTXP01C0BQL.13.38.D05.1.454.CMB.2.raw
  modified_base (242)..(242): a, c, t, g, unknown or other
  modified_base (269)..(269): a, c, t, g, unknown or other
  modified_base (329)..(329): a, c, t, g, unknown or other
  modified_base (452)..(452): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgcaagtccagccagtagttgttttanacagcctaccaaacaataagtaacttntagcttaggtaccagcaacgaaaccaggacacgccctacctaagctcgctacatttacgngggcatctacgtccgggaactcccggggtccccctcggacgtattccgagtcggcgaaggcgggtctggggacaggtatttcgactctacaccgatcagcacgtcctgaccaggctagaaagngttgggggttacggacgtttaagttttaacgttaccgtgtaccgtaagtacctaaattaatttactaacgttacccgtaaccttcccggaggtccttccgttaaccggtttcgggacgggttaaacgggaccgtaaaggggtcgaagactacgaaacgtaacgttggtaacg

SEQ ID NO: 437304 - DNA, 591 bp, Homo sapiens
  misc_feature: GZ8MTXP01C921U.13.38.D05.1.454.CMB.2.raw
  modified_base (426)..(426): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtgggggtccctcagactctcctgtgcaacctctggattcattttctctgacgtcctggttgagcgtgggtccgccaggcgtcccggggaaggggctggaggtgggttggaccgtaagttaaaggtagaagacgagtggtcgacaacagactacgagtcgtcccgtaagaaagcagtattcactatctacaaganatagactacaaaagaaatagaatatatctagacaaaatcgaaacaaactagaaaagcgaaggacacgaggtacgtagtaattacgtcgtaaccaacgagagtcgggacaagattagcaaagtcgggaccgcgaacggtaggttccgaacgttcggtaaccggggg

SEQ ID NO: 437305 - DNA, 562 bp, Homo sapiens
  misc_feature: GZ8MTXP01B5CIZ.13.38.D05.1.454.CMB.2.raw
  modified_base (348)..(348): a, c, t, g, unknown or other
  modified_base (373)..(373): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaacgccccgaacctcctgatctacggtacatccactttgcacagtggactcccatccaaggttcagtggcaagtagntcgtaggaactagtacttttacccncaccatcgaggggtctacagcctagaagtatttcgcgtacttactattcgtacgaactagtacgtttacccttccgtcccccggtacgttcggacccgaacggtaccgaacggtacggtaaataacgaaacgacgtaacgttggtacggcttcggcaccaatctcgttcttcttacttcttccgttccg

SEQ ID NO: 437306 - DNA, 601 bp, Homo sapiens
  misc_feature: GZ8MTXP01B1ONA.13.38.D05.1.454.CMB.2.raw
  modified_base (244)..(244): a, c, t, g, unknown or other
  modified_base (333)..(333): a, c, t, g, unknown or other
  modified_base (527)..(527): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagactccctggctgtgtctcgtgggcgaggacgggccaccatcaactgacaagtccagccagtagttgtttanacagctaccaaacaataagtaacttctagcttaggtaccagacaagaaaccaggacacgccctactaagctcgccttactattttacgngggctattccgtaacgtccggggaacgttcccgggggtaccccctaggaccgtattccgaggtcgggactgggccggggtcgtaggggactaggtacttcactctacacatcagcacgcctgcgagctaggaagtcgtgggtaggtcttaagtttatacgtgacagtactaattattatacgtacctcgtacgngtcttcgtaacgttcgggacgggttacggaaccgtaagggtcggaataacgacgaaacgtaacgttggtaacgg

SEQ ID NO: 437307 - DNA, 578 bp, Homo sapiens
  misc_feature: GZ8MTXP01AN4K7.13.38.D05.1.454.CMB.2.raw
  modified_base (312)..(312): a, c, t, g, unknown or other
  modified_base (431)..(431): a, c, t, g, unknown or other
  modified_base (552)..(552): a, c, t, g, unknown or other
  modified_base (564)..(564): a, c, t, g, unknown or other
  modified_base (577)..(577): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctcactccaccctgtctgcgtctctcggagacaggtcaccatcacttgtcggcaagtcagaactagttggacaacttctttaaatggtatcagcagagtcgagggcaacgccccgaactcctgatctacgtacatcctacgtttncacgagtcggactccatacccgaaggttcgaaggttcgacgtaaagtagtcgtaccgtaaggaactacgtacttttacccacactatcgtaacgggtcaacgtgtacctagtaaagttntttacggctaaccttatatttacgacgtaacgtagtaccgttacctcccgtaccccggtacgttccggaccgaacggtaccgaaggagaacgtaacacgcggaattcgtgacgttcgcacnctcgtcttctcnctaaccgttcccnc

SEQ ID NO: 437308 - DNA, 698 bp, Homo sapiens
  misc_feature: GZ8MTXP01B2ETV.13.38.D05.1.454.CMB.2.raw
  modified_base (232)..(232): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacnttggactaacttctttaaattggtatcagacagagtcgaggcaacgccccgactcctgactctacggtacactacctactttgactactaggtacgggactacccgaattaccgtaaggttacaggtcggactaaaggtaagtctcgtaaggaaacctaacgttaccttttaaccccactaacccgtagttaccgacgggggttacctaacgacgtacccgttaaggtaaacgtttagttttacgtaccgttaactttaacgttaagtttacggttacctaaacgttaacgggtttaaccgtttaccccgtttcccgttaccccccgggtacggttcccggaacccggtaacgggtaaacccggtaaacggggtaacggtaaacgtaacgtaaacggacgtaaaccgttaggtcggtacgttcggttcaccgtaactcgtgttccttcttactccttccgtaaccc

SEQ ID NO: 437309 - DNA, 774 bp, Homo sapiens
  misc_feature: GZ8MTXP01EXQ2I.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatcccaccctgtctcgtcgtcctcgtacggacgacgacggtccacctatcgtacgttcgggtacggacaagtacaagtaactagtacgtactaactttactttaaagtggtactcgagacgaagtaacgtacggagggacccaacccggacccccgtaacctccgtagtaacctccgtaaaccgtactactacccgttacttacgacgtacgtaggtcggtacctacccgtagttaccggtaacggttacgaggggtcgaaccgtaaaggtaacgtcgttacggtaacgggtaaactacgttttaccccttttaccccgactaaccgtacgtacggtacgggttaccaacgtcgtaccgttaaaggtagtttcgttacgacttacgtttaacttagttactaacgaactttaacgggtaccctttacccgtcccggttaccccggtacggttccggaacccggtaacggtaaaccggtaggtaaacgtaaccgtaaaggacccgttaaaggtccgttagggtaccgtcgttacccgttacttacccgttaacgttccttaaccggttacttaccgtttccgtaacccctttcccggttaacc

SEQ ID NO: 437310 - DNA, 630 bp, Homo sapiens
  misc_feature: GZ8MTXP01EY38U.13.38.D05.1.454.CMB.2.raw
  modified_base (598)..(598): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctctcggagacgagggtcaccatctacgttggtcgggacaagtacaagaaactagttcggactaacttactttaaaagttggtatacagacaagaagtcgaggacaacgccccgaacctccgagactcgtaacgtactaactacctacttacgtacaacgtacgtacgggtacgtaccctactaaccgtacggttaacgtacgtaggtccgtaaagtagtaagtactaggtaacggtaaactaacgtttacccttacctactaactacggtacgggtacgtactaacgcgttaacgaagttattcgttacgactaattatgtactactaagtacgttaccttacgtccccgacgtcgtacggacgtaacgacgtagaaagtaactaacgcggattgtcgtgacgcacncgtactcgtcttcttctaaccttcccgtaacc

SEQ ID NO: 437311 - DNA, 650 bp, Homo sapiens
  misc_feature: GZ8MTXP01BGSMQ.13.38.D05.1.454.CMB.2.raw
  modified_base (485)..(485): a, c, t, g, unknown or other
  modified_base (581)..(581): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcggtgggggggcttgggtaacggcccgggggtcctcgagactctcctgtgcaacctctggattctatttctctgacgtcctggtgagtcgtgggtccgcgacggccggtcccggggaagggccgtgggacggttggggttggaccggttaagttaaagggtaggaaacgtacgtagtacgggtacggaacaaacgagaaccctacgtagtcggttacccgaggtaaaaacggcaaggtacttcgaactactacgtacaaagtagatagaacctaanaaaagtaatagtaaatattatacgtagaactaaagtagaaaccaacgtaagaaaacgcgaaggaacacgagacgtagtattactagtaccagaagngcgggacagatagacgaaagttcggaaccacgaacgtagttccgaacggtaaccgttcggggaacccgg

SEQ ID NO: 437312 - DNA, 611 bp, Homo sapiens
  misc_feature: GZ8MTXP01BJBGE.13.38.D05.1.454.CMB.2.raw
  modified_base (237)..(237): a, c, t, g, unknown or other
  modified_base (249)..(249): a, c, t, g, unknown or other
  modified_base (261)..(261): a, c, t, g, unknown or other
  modified_base (313)..(313): a, c, t, g, unknown or other
  modified_base (349)..(349): a, c, t, g, unknown or other
  modified_base (360)..(360): a, c, t, g, unknown or other
  modified_base (368)..(368): a, c, t, g, unknown or other
  modified_base (373)..(373): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctaccaanaataagaacttnttagcttggtaccagcagaaaccaggacagcctctaagctgctcatttacgnggcatctagtccgggaatccggggtccccctgacgnttcagtcgcgngcgggtcnggganagtactttcactctcaccatcagcagcccgtagcgaggtctaggaacgtagttggggtacggtcgttaagtttactttaaccgtgttaccgagtacctaaattaacttaactaacggttaaccctccccggttaccggacggtcccgttacgtaaccggttttccggggaccgggttacggggttaaccggtaaacggggtcgggaagaactacggaaaaccgtaacgttaaggtcgg

SEQ ID NO: 437313 - DNA, 596 bp, Homo sapiens
  misc_feature: GZ8MTXP01BG9RX.13.38.D05.1.454.CMB.2.raw
  modified_base (241)..(241): a, c, t, g, unknown or other
  modified_base (323)..(323): a, c, t, g, unknown or other
  modified_base (378)..(378): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgacaagtccagccagtagttgttttanacagctaccaaacaataagaacttctagcttaggtaccagacaagaaaccaggacagccctctaaagctgctctatttacgngggctatctagtcccgggaagtcccggggtcccctggaccgtgttcgagtcggcnggccgggtgtgggactagtacttcactctcacatcagcacgcctgacgagtactaggaagtagtggggtacgggtacttaaggttttacttacgtggtaccagtactaattattactacgttaacctcctcggaaggtccttacgtaaccgttcggggacggttacgggaaccgtaagggtaggaagtaactacgaaaacgtaaccgttggtaaccgg

SEQ ID NO: 437314 - DNA, 690 bp, Homo sapiens
  misc_feature: GZ8MTXP01AN6SG.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacgttgtcgggcaagtcaagaactattggacaacttctttaaattggtatcagcagaagtcagggcaacgccccgaactcctagactctacggtacatcctactttcgacacgaggttcggactcccgatccccgaaggtttcaggtggcaaagtagaactcgtaagggaaactagttaaccttttacccgactacctatacggaacggggttcctaacgagtcccgtaagaacggttatttcgacgttaacttaacttagttacgtacctaaactacggttaaccgtttaccccgtttacccgtaccccccgggttaccggtttaccggtaccccgaaacgggtaaccccggtaaagggtttaacggaaacgttaactaaacggacggtaaacccgtttgaacggggtcttacgggttaccacccgtaactttactcggtttaaccttcttaaccgtttccgtttccccgtaaccccg

SEQ ID NO: 437315 - DNA, 536 bp, Homo sapiens
  misc_feature: GZ8MTXP01AOWQM.13.38.D05.1.454.CMB.2.raw
  modified_base (259)..(259): a, c, t, g, unknown or other
  modified_base (310)..(310): a, c, t, g, unknown or other
  modified_base (350)..(350): a, c, t, g, unknown or other
  modified_base (368)..(368): a, c, t, g, unknown or other
  modified_base (514)..(514): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccacatcaactgcaagtccagccagagtgtttatacagctacaacaataagaacttntagcttggtaccagcaagaaacaggacagcctactaagctgctcatttacngggcatctatccggatccgggtcccctgacatcgagtgcngcgggtcgtgggacagtnttcactctcacatcagcacgcctgcgagtcagaagtatggggtacgtagttagtttacttacgtgtacagtactaattattactacgttcctccgtcgaggtccttcgtaccgttcggacggggttacgacgtaagggtgaagtanacgaaccgtaagttggtaacgg

SEQ ID NO: 437316 - DNA, 657 bp, Homo sapiens
  misc_feature: GZ8MTXP01A2TJX.13.38.D05.1.454.CMB.2.raw
  modified_base (244)..(244): a, c, t, g, unknown or other
  modified_base (399)..(399): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagactccctggctgtgtctcgtgggcgagacgggccaccatcaactgacaagtccagccagtagttgttttanacagcctacaaacaataagaacttctagcttggtaccagcaagaaaccaggacacgcctacctaagctagcttactatttacgtgggacattcgttaacgtcccgggaaacgtccccgggggtaccccctcggaccgtatttcgagttcgggccngggtcgggtccgtgggactaggtactttcactcctcacatcagcacgccgtgcgtagggctagaagtagtggggtagggtcttaagttttactacgtgtacgaacgacttaaagttattaacgttaacgttccgttaaccgtcccggttaaggtcccttacgttaccggtttaccggggacggggttaaccggttaacccggtaaggggtaggtaacggtaacgtaaaccggaaaacgtaaccggtttaagggtccgg

SEQ ID NO: 437317 - DNA, 586 bp, Homo sapiens
  misc_feature: GZ8MTXP01DGA5H.13.38.D05.1.454.CMB.2.raw
  modified_base (345)..(345): a, c, t, g, unknown or other
  modified_base (366)..(366): a, c, t, g, unknown or other
  modified_base (387)..(387): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggacaactcttaaatggtatcagcagaagtcagggcaacgccccgaactcctgactctacggtacatccactttgcacagtggactccatccaaggttcagtggcaagtagntctggaacagtactttacccncacctatcgaggggtctacgngacctagaagtattttgacgtacttactattcgtactaaactagttacgttacccttccgtcccccggtacgtttccggacccgaaacgggtaccgtaaagggtaggaaataacgaaaggacggtaaaccgttgggtacgtcgttacggccttaaccgtaattacgtcgttccttacttacttcccgttcccgtaaccc

SEQ ID NO: 437318 - DNA, 590 bp, Homo sapiens
  misc_feature: GZ8MTXP01BF2ID.13.38.D05.1.454.CMB.2.raw
  modified_base (239)..(239): a, c, t, g, unknown or other
  modified_base (317)..(317): a, c, t, g, unknown or other
  modified_base (371)..(371): a, c, t, g, unknown or other
  modified_base (413)..(413): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgtttanacagctaccaaacaataagaacttctagcttggaccagcaagaaaccaggacagccctactaagctgctctatttacnggcatctagtccgggagtcccggggtccccctagaccgtattcgaggtcggcgnggcgggttcgaggggaacagtactttcaactctacaccctanacgacgcacgtcctgcgaggctaaggaagtgtggggtacgtattagtttatacgtgtacgaagtaataattattacgtacgtccctcccgtcgttacggtccttacggtacggttccggggacgggacggaacggtaagggtagaacgtaacgtaacgaaaccggtgttcgggtaag

SEQ ID NO: 437319 - DNA, 770 bp, Homo sapiens
  misc_feature: GZ8MTXP01BM0Q4.13.38.D05.1.454.CMB.2.raw
  modified_base (242)..(242): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatgacccagtctccagactccctggctgtgtctgtgggcgaggacggccacatcaactgacaagtccagccagtagttgtttanacagcctaaccaaataaataaacgtaacttcttagcgttaggtaaccagacaacgaaaccgaggaccacgaccctacctaaagctacgtctactactttacgacgggtactacgttacgttaaccgtacccggggtaaacggttccccgggggtcccccctacggtaccgtagttaccgagggttcgggaccgtcggggtccggggttcgtacggggtacgtaacggttactttaccaacccttctacctaacctacgtacgacgtacacgtcccgagacgacggtactaagaaagttgtgggggtacgtaacgtttaagttttaacggtttacgtacggtacctaaggttaaacctaaagtttaactttaacggttaccgttaacccgttaaccccggtaccgggttaaccggtcccgtttaaccgttaaccggggtttccgggggaccgggttaacggggaacccgggttaaggggtaccgggtaagaacgttaaaccggaaaacggtccgttaagggtaaccggg

SEQ ID NO: 437320 - DNA, 557 bp, Homo sapiens
  misc_feature: GZ8MTXP01AY9NG.13.38.D05.1.454.CMB.2.raw
  modified_base (314)..(314): a, c, t, g, unknown or other
  modified_base (353)..(353): a, c, t, g, unknown or other
  modified_base (363)..(363): a, c, t, g, unknown or other
  modified_base (371)..(371): a, c, t, g, unknown or other
  modified_base (410)..(410): a, c, t, g, unknown or other
  modified_base (416)..(416): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagtagtgtttatacagctaccaacaataagaacttctagcttggtaccagcaagaaaccaggacagcctctaagctgctacatttacngggcatctagtccgggaagtccggggtcccctgaccgtnttcgagtgcnggcgggtntgggacagtactttcactctacactatcagcacggtccngcgagntagagtgtggggtgtattagtttactagtgtacgtagtactaattattaactacgtacctccgtacggacgtccttacgtaccggttcgggacgggttacgggacggtaagggtgaacgagtaacgaacgtaacgttggtg

SEQ ID NO: 437321 - DNA, 596 bp, Homo sapiens
  misc_feature: GZ8MTXP01DHJBI.13.38.D05.1.454.CMB.2.raw
  modified_base (239)..(239): a, c, t, g, unknown or other
  modified_base (374)..(374): a, c, t, g, unknown or other
  modified_base (387)..(387): a, c, t, g, unknown or other
  modified_base (420)..(420): a, c, t, g, unknown or other
  modified_base (437)..(437): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctaccaaacaataagaacttctagcttggaccagacaagaaaccaggacacgccctacctaagctgtctacattttacgtgggacattcgtacgtaccggggaacgtccccggggtaccccctggaccgtnttccgaggtggcnggtcgggtcgtaggggacagtactttcgactcncacatcagcagcctgcngctagaagtagtgggtggtctaagtttatactgtacagtactaaattattatacttacctcctcgacggtcttacgtaccggtttcgggacgggacgggttaaccgtaagggtaggtaacgtaacggtaacgaaaccgggttaacgttggttaaccggg

SEQ ID NO: 437322 - DNA, 553 bp, Homo sapiens
  misc_feature: GZ8MTXP01EWL6Z.13.38.D05.1.454.CMB.2.raw
  modified_base (281)..(281): a, c, t, g, unknown or other
  modified_base (374)..(374): a, c, t, g, unknown or other
  modified_base (412)..(412): a, c, t, g, unknown or other
  modified_base (498)..(498): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagcctggggggtcccctcagactctcctgtgcaacctctggattcattttcnctgacgcctggttgagctgggtccgccaggctcccgggagggctggagtgggtgccgtattaaaggtgaagacatggtcggacaacagactanagtgtcccgtagaaaggcagattcactatctcaaaganatgaactcaaaagaaatagatatatctagacaaatgaaacaactagaaaagcgaaggacacgaggcgtagtattactgtacccaanagatgggacagattgcaaagtggccgcgacgagttcgaacgttcgtaaccggggg

SEQ ID NO: 437323 - DNA, 736 bp, Homo sapiens
  misc_feature: GZ8MTXP01EUJYZ.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctcgtcggagacgaggtccacatcacgttggcggacaagtcaagaactagttcggactaacttactttaaagtggtatcagacaagaagtcgaggaccaacgcccccgtaacctcctagactacgtaacggtacacgtccctagtttcgactaacgaggttcggactccccgtaattacccgtaaggtttacgaggtcggtaccgtaaaaggttagtaacgttacggtaaacgggaaaccttaacggtttaaacccctttttaacccccggactaaacccgtacgttaccgggtaacgggggttacctaacgtaccggtacccgttaaggtaaacgtttacgtttacgtaaccgttaacctttaacgttaacttacgtaaccgtaaacgttaacgttacccgttaccccgttccccgtaccccgggtacgtccggtaacccggtacggtaaaccgaacggtaaggaaacgtaactaaggttaacgtacgttaggtcggtcgttacgcaccgtctcttcgttcttccttacttccttcccgtaaccc

SEQ ID NO: 437324 - DNA, 699 bp, Homo sapiens
  misc_feature: GZ8MTXP01AE1GO.13.38.D05.1.454.CMB.2.raw
  modified_base (242)..(242): a, c, t, g, unknown or other
  modified_base (329)..(329): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccacatcaactgacaagtccagccagtagttgttttanacagcctaccaaactaataagtaacttcttagcttaggaccagacaagaaaccaggacagccctacaagctagtctactatttacgngggactactcgtacgtaccggggtaacgttccccgggggtcccctacggaccgtagttccgaggttcgggcgtaacgggtccggggtacgtaggggaactaggtactttaccgacttcctaccacctactcgaacgtcacggccctaggacccgtaggtccgtaaggtaaacgtggttagggggttacggtaccgtttaaagttttaaccgttacgtcggttaccaagtaacttaaattaagtttaacttaacggttaccctaacccgtacggttacggtaccttaccgtaccggtttccggggacgggttacgggttaaccggtaagggtacggaacgtacgtaacgaaaaccgtaagttcggtaacgg

SEQ ID NO: 437325 - DNA, 808 bp, Homo sapiens
  misc_feature: GZ8MTXP01CE7DP.13.38.D05.1.454.CMB.2.raw
tcagtcacgtactacacgaccggtgctcgatttagtatctgatagttgggtttggggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtccaccatctacgttcggtcgggactaaagtcgaagaactagttcggactaacttactttaaattggtatcagacagaagtacgacgggaccaaccggcccccgtaacctcctagacttccgtaacggtactacttacctactttcgacacgtaggtcggtactacccgatacccgtaaggtacaggtcggactaaagtagaatcgtaaaggaaacctacgttaacctttaccccgtacaacccgtagtaccggtaacggggtacctaaccggtacgttacccgttaaggtaaacggtttacgttttaacggtaccgttaaacctttaaacgtaagtttaccgttaacggtaaaaccgttaaccgtttaaacccgtttaccccgtttaccccggttacccccgggttaacggtttacccggggtaaacccggtaaaaccggggtaacccgtaaaaacggggtaacgggtaaaaaccttaacggaaaacggttaccgggtaaacccgttagggtaccggtaccgttacgggttacccttaacccgtaacttaaccttcggtttacttaccccgttacttaacccccggttcccgttaaccccg

SEQ ID NO: 437326 - DNA, 584 bp, Homo sapiens
  misc_feature: GZ8MTXP01A1P97.13.38.D05.1.454.CMB.2.raw
  modified_base (559)..(559): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaacttctttaaagttggtatcagcagaagtcgagggacaacgccccgaactcctgactcgtacgtacactcctactttgcacgaggtcggactcccataccgaaggttcaggtggacaaagtagtaagtacgtagggaaactagttaacctttaccccgtctaaccctatacgtacggggtactaacgagtccgtagtaagttagttttcgacgttacttaatattacgtacaactaggtacgttacccttccgtaccccggtcgtcgaccgacggtacaaggtacgaagtaacgaagacgacttgtgtcttgcacgtntcgtctcgtcacgtccttcccgtcc

SEQ ID NO: 437327 - DNA, 788 bp, Homo sapiens
  misc_feature: GZ8MTXP01CW098.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctcgtcggagacgagggtcacctatctacgttggtcgggacaagtcagaactattcggactaacttactttaaagttggtatacgagcaagaagtacgacgggaccaaaccgccccgaacctccgtagtacctaccgtaacggtacctactaccctactttcgaccacgtacggtacggacctacccgtataccccgtaaagggtttcgagggtacggaccgtaaaagttaaggtaacttacggtaaacgggtaaaaccgttaacggtttaaccctttttaaccccccaccgtaaacccgtacgttacccgggtaacggggttaccctaacgtacgtaccgtaaggtaacgtttacgtttacgaccgttaacttaacttagttacgttaacgtaaccgtaacggtttacccgtttaccccgttaccccggttcccccgggtaacggttaccccggaacccggtaaacggggtaaacccggtaaaggggtaacggtaaaacttcggaaacggttaccggtaaacgttcggtacggcgttaccggccttaccgttaactaccgttcgttccttaccgttaccttccccgttcccgtaaccg

SEQ ID NO: 437328 - DNA, 509 bp, Homo sapiens
  misc_feature: GZ8MTXP01DBQZN.13.38.D05.1.454.CMB.2.raw
  modified_base (220)..(220): a, c, t, g, unknown or other
  modified_base (338)..(338): a, c, t, g, unknown or other
  modified_base (340)..(340): a, c, t, g, unknown or other
  modified_base (459)..(459): a, c, t, g, unknown or other
  modified_base (466)..(466): a, c, t, g, unknown or other
  modified_base (469)..(469): a, c, t, g, unknown or other
  modified_base (477)..(477): a, c, t, g, unknown or other
  modified_base (481)..(482): a, c, t, g, unknown or other
  modified_base (492)..(492): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcactgtcggnaagtcagacattgacaactcttaaatgtatcagcagaagtcagggcaacgccccgaactcctgatctacgtacatccatttgcacagtggatccatccaggttcagtgactaagtaantntaggaactagtaactttacctacaaccatcgacggggtactacagtcctagtaagtatttgacacttatattgacaagatagttacctcgtccccgagttcgacaacgggacgtaaggnggaaaanaanaagacacngtgnngcacaatctntctcttactcttccgtc

SEQ ID NO: 437329 - DNA, 644 bp, Homo sapiens
  misc_feature: GZ8MTXP01AQKOR.13.38.D05.1.454.CMB.2.raw
  modified_base (484)..(484): a, c, t, g, unknown or other
  modified_base (587)..(587): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtgggggtccctcagactctcctgtgcaacctctggattcattttctctgacgtcctggttgagctgggtccgccgaggccgtccccggggaaggggcgtggacggtggggttggaccgtaagttaaaaggtagaaagacagtggtacggacaacacgaactacgagtcgttcccgtaagaaacgggcagtattaccactatctacaaagagtataggaactaacaaaaagtaatagaattaatactactaanaactaaagtaacgaaacgaaacgtaaaggaaaacgacggaacgaacgacgaaggtacgttaatacgttacgtacgaaccaagaagacggtacggacgaagtanacgttacaacggtcggccgaacggacgtacgttaccggtaacgttcgggtaaccggg

SEQ ID NO: 437330 - DNA, 651 bp, Homo sapiens
  misc_feature: GZ8MTXP01BIYFO.13.38.D05.1.454.CMB.2.raw
  modified_base (247)..(247): a, c, t, g, unknown or other
  modified_base (339)..(339): a, c, t, g, unknown or other
  modified_base (518)..(518): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatcgacccagtctccagactccctggctgtgtctcgtgggcgagacgggccacatcaactgacaagtaccaaccagtagttgttttaanacagtcctaccaaactaaataaacgtaacttctagtctggtaaccagacaagaaaccaggaccacgccctacctaagctgctactatttcgnggcattcgtacggtaccgggaacgtccggggtccctcggaccgtatcgaggtggaaccgtagggtcggggtctggggactagttactttcacttcctaccacctacgtacgacgcctaacgcccgtggacgacggtctaggaagagttcggtggggtactttaaggttttactacgttntacgagtaactaatttattaacgtacgttaacctccgtaacggtacgttccttacgttaccgttcggggagggttaccggggacgttagggtaacggaagtaacgtaacgaaaccggttacgtggttgaaccg

SEQ ID NO: 437331 - DNA, 671 bp, Homo sapiens
  misc_feature: GZ8MTXP01ANCI1.13.38.D05.1.454.CMB.2.raw
  modified_base (377)..(377): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcacatcacttgtcggcaagtcagaacattggcaactctttaaattggtatcagcagaagtcagggcaagccccgaactcctgatctacggtacatccactttgcacgagtcgggactcccgataccaaggttcaggtgacaagtagaatctagggaactagtacttttacccncacccatacgaggggtctacgagacctagtaaacgtattttcggacttacgtttaacttattacggtacctaaacgtaacggttacgtttaaccccgtttaccgtaccccccgggttacggttacccggttaacccggaaccggggtaaacccggtaaacgggtaaacgggtaaacggttaaacgaacggttaaacggtaaaccgttacggtacggtaccgttacggttaccttacccgtaaccgttacttccggtttccgttaccgttactttcccttaaccccggttccccg

SEQ ID NO: 437332 - DNA, 586 bp, Homo sapiens
  misc_feature: GZ8MTXP01AB8SV.13.38.D05.1.454.CMB.2.raw
  modified_base (361)..(361): a, c, t, g, unknown or other
  modified_base (539)..(539): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtcaccatcacttgtcgggcaagtcagaacattggacaactctttaaattggtatcagcagaagtcagggcaacgccccgaactcctgactctacggtacactcctactttgacacgaggtcggactcccataccgaaggttcaggtggacaagtagntacgtaggaactagtacttttacccacacctatcgtacggggtactacgacgtcctagtaacgtattttacgacgttaacttacttattacgtactaacgtacgttacgttacccttcccgtaccccggtcgtaccgaccgaacggtacgtaaggtacggaataacgaagacgtacgngtcggtcgcgcacgctactcgtactcgttactccgttcccgtaaccg

SEQ ID NO: 437333 - DNA, 624 bp, Homo sapiens
  misc_feature: GZ8MTXP01CAUHK.13.38.D05.1.454.CMB.2.raw
  modified_base (223)..(223): a, c, t, g, unknown or other
  modified_base (365)..(365): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtccaccatcacttgtcggnaagtcagaacattggactaacttcttaaattggtatcagcagaagtcagggcaacgccccgaacctctgactctacggtactactcctactttgacacgaggtcggactcccatacccgaggttcagtcgacgaagtaagtntacgtagggaaactagtacttttaccccactaactactcgtagggtactacgacgtacctagtagtagttttcgacgtacttactattacgtaacgaacgtagttaccgtttacccgttcccgtcccccgggtacgttcggtaacccgacgggtaaccgtaaaggtacggaaactaacgtaaggacccgtaagttaggtcggtcttcggccttacctaagtcttcgttaccttcttaccttccgttccccgttaacccg

SEQ ID NO: 437334 - DNA, 612 bp, Homo sapiens
  misc_feature: GZ8MTXP01BGY2E.13.38.D05.1.454.CMB.2.raw
  modified_base (323)..(323): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgacaagtccagccagagttgttttatacagctaccaaacaataagaacttctagcttaggtaccagacaagaaaccaggacagcctactaagctgctactatttacgngggctatcgtaacgtccgggaacgtcccgggggtaccccctcggaccgtattcgaggtcggcgaagggtccgggtcgtacggggactaggtactttcgaacctctaccacctatcacgcacgcctgcgaggctaggaagtagtgggtaggtcttaagtttatacgtgtacgaagtaactaagttaattactacgtaccctcgtccgttaggtccttacgtacggtttcgggacggacgggaccgtaagggtggtaacgtagtaaccgaaacggtaacgttggtaaccgg

SEQ ID NO: 437335 - DNA, 713 bp, Homo sapiens
  misc_feature: GZ8MTXP01DAJPR.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacaggtcaccatcacttgcggcaagtcaagaacagttggactaacttactttaaattggtatcagacgaagaagtcgaagggcaacgccccaacctcctagactcgtacggtactactcctactttgccaacgtagtcggacttaccccgataccgaaagggttcaaggtcggactaaaggtacgtaagtacgttaacggaaacctacgttaaccttttacccctcaaaccctagtacggtacgggttactacgacgtaccctaggttaaacgttagtttacggactaaccctttacgttaagttacggtaacctacgtttaaacgtaccgtttaccccgttacccggtcccccgtacgggttacccgtaaccggaaacgggtaaacccgtaaaggtaacggtaaaagaacgttaaacggacggtaaaccgtttggaaacgggttcacgggttaccaacccggtttaactctttcggttacccttcttaacccggttcccgtttccccgtaacccg

SEQ ID NO: 437336 - DNA, 634 bp, Homo sapiens
  misc_feature: GZ8MTXP01BFLF3.13.38.D05.1.454.CMB.2.raw
  modified_base (246)..(246): a, c, t, g, unknown or other
  modified_base (335)..(335): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccacggggacatcgtgatgacccagtctccagacctccctggctgtgtctcgtgggcgaggacgggccaccatcaactgacaagtccagccagtagttgttttanacagctaccaaacaataagtacttctagcttacggtaccagacaacgaaaccaggacacgccctactaagctgacttactagtttacgngggctactcgtaacggtaccggggaacgttccccgggggtaccccctacggaccgtagttccgagggtcgggaccgtaaggggtccgggtacgtaggggaacctaggttactttccaacctcctacaaccctatcgagcgacgcctgcgtaggctagaaagtgtggggtacgtacttaagtttacttacgtgtacagtaactaaattacttaaagtccgtacctccgtacgagtccttcgtacggttcgggacggttcggaacgtaagggtgaagtactacgaaacgtcgttggtaacg

SEQ ID NO: 437337 - DNA, 619 bp, Homo sapiens
  misc_feature: GZ8MTXP01A00XU.13.38.D05.1.454.CMB.2.raw
  modified_base (241)..(241): a, c, t, g, unknown or other
  modified_base (290)..(290): a, c, t, g, unknown or other
  modified_base (321)..(321): a, c, t, g, unknown or other
  modified_base (434)..(434): a, c, t, g, unknown or other
  modified_base (593)..(593): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagactccctggctgtgtctcgtggcgaggacggccacatcaactgacaagtccagccagtagttgtttanacagctaccaaataataagacttctagcttaggaccagacaagaaaccnggacagcctactaagctgctactatttacgngggctaacgtctaacgtaccggggaacgttccccggggtacccctaggaccgtattcgaggtcgggcgaagggtcgggtcgtagggacctagtactttcactctacgaacctntccgaagcacgtccgtagccgaggtctaggaagtacgtggggtacggtctttaaggtttactactcgtacgagtaactaaattacttaacgtacgtaccctccgtacgttacggtccttaccgtacggttcgggacggacggaccgtaagggtaggaanacgtaccgaaagtaacgttgtaacgg

SEQ ID NO: 437338 - DNA, 793 bp, Homo sapiens
  misc_feature: GZ8MTXP01EHY2F.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctctcggagacgagggtccaccatctacgttggtcgggacaagtcagaacagttggactaacttactttaaattggtatacgagacgagaagtacgagggaccaaccgccccgaacctcctagactaccgttacggtacctacttcctacgtttcgacgacgtaggtacgggtactacccgattaccgaaggttacaggtggtaagtaacgatcgtaggtaaactacgttaaccttttaccctacacctagttacggacgggttacctacgacgtaccttaggtaaacgtttacgtttttcgaacggtttaacctttaaccgtaagttttacgtaaccctaaaccgggttaacggtttaacccggtttttaaacccccgtttaccccggttacccccccggggttaaccgggtttacccgggaacccgggttaaaacgggaaacccggtaaacggggttaaacggtaaaacggttcgaaaacggttaaccgggttaacgtacgggttcgggtacccgttcggacccgttaacccttaacttcccggtttaccgtttcctttaccctaccgttttccccttcccccggttaacccgtttaaccg

SEQ ID NO: 437339 - DNA, 749 bp, Homo sapiens
  misc_feature: GZ8MTXP01DLLF1.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatcagatgagccagtctcatccaccctgtctgcgtctcgtcggagacgagggtcaaccatcacgttggtcgggacaaaggtcaagaactagttggactaaacttactttaaaatggtaatcgagacaagaagtcgaacgggacaaaccggcccccgtaaacctcctaggaacttaccgtaacggtacctacttaccctaactttcgaccgtaacgaggttacgggaacctaccccgaattaccccgtaaagggttcaaggttcgacgtaaagttaagaagttaccgtaaagggaaacctaacgttaaccttttaaccccactaacctacgtacgtaacggggtactaacgacgtacccgttaagtaaacgttagtttcggaacttaccttaacgtttattacggtaactaaacgtaacgttaaccggtttaccccttacccggtaccccggtaacggttccggaacccggaaacgggaacccggtaaagggaacgtaaaggtaacccgaaagttacgtaaccgttagacggtacgttaccgttccgaccgtaactcttcggttaccttacgttacccgtcccgtttcccgtaaccccg

SEQ ID NO: 437340 - DNA, 641 bp, Homo sapiens
  misc_feature: GZ8MTXP01COSA8.13.38.D05.1.454.CMB.2.raw
  modified_base (244)..(244): a, c, t, g, unknown or other
  modified_base (301)..(301): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatgacccagtctccagacctcccgtggctgtgtctcgtgggcgagaggccacatacaactgacaagtccagccagtagttgtttanacagctaccaaataataagtaacttctagcttggtaccagacaagaaaccaggacancctacctaagctgctactattacgtgggactacgttactacgtaccggggacgttcccggggtacccctcggaacgtagtttccgaaggttcgggaccgtaacgggcggggttcgtacggggactagtacgtttccactcctaccactacgtcaacgcgaacgtccgtagaccgtaggactaggaagtagtcggggtagtacgttaagtttacgttacgtgtacgagtaactaattaacttatacgtaccttccgtcgacgtccttacgtaaccggtttcggacgggttaacggaccgtaagggcgtaagtaacgtaacgaaacgtaacgttcggtaacg

SEQ ID NO: 437341 - DNA, 612 bp, Homo sapiens
  misc_feature: GZ8MTXP01AYDA9.13.38.D05.1.454.CMB.2.raw
  modified_base (282)..(282): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttgggttaagccgtggggggtccctcagactctcctgtgcaacctctggtattctattttcnctgacgcctggttgagtcgtgggtcccgccgaggccgtccccggggaagggcgtgggaggtggggttggccgtaagttaaaggtagaagacagtcggtcggaacaacacgactacgagtcgtacccgtaagaaagcagattcactatctacaaagagatgaactacaaaagaatagaattatatctagacaaatacgaaaccgtaaacgtaagaaaacgcggaaggaaccacgaggacgtagttaattactacgtaacccaagtagagtcgggacagattagcaaagtcgggccgaacgcgacggttcgaacgttccgggtaaccggggg

SEQ ID NO: 437342 - DNA, 615 bp, Homo sapiens
  misc_feature: GZ8MTXP01EZFWI.13.38.D05.1.454.CMB.2.raw
  modified_base (334)..(334): a, c, t, g, unknown or other
  modified_base (398)..(398): a, c, t, g, unknown or other
  modified_base (409)..(409): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatgacccagtcctccagacctccctggctgtgtctcgtgggcgaggacggccaccatcaactgacaagtccagccagagttgttttatacagctaccaaacaaataacgtaacttcttagcttacggtaccagacaagaaaccgaggacacgcctactaagctgctactatttcgnggctacgtcgtacgtccggggaacgttcccggggtccccctaggaccgtattcgaggtcggcgnggtcgggtcgngggactagttacttcactcctacactatcgagcacgcctgcgtaggctagaagtgtgggtgtacttagtttactcgtgtacaacgtataagttacttactacgtccctccggtaccgttaggtccttaaaccgttcgggttacccgggagggttacggaaccgtaaggggtagtaacgactaaacggacgtaaccgttgggtaacg

SEQ ID NO: 437343 - DNA, 685 bp, Homo sapiens
  misc_feature: GZ8MTXP01BBP61.13.38.D05.1.454.CMB.2.raw
  modified_base (390)..(390): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacgagggtccaccatcacgttggtcgggacaagtcaagaactagttggactaacttctttaaaagttggtatcagacaaggaagtcgaagggaccaaccggacccccgaacctcctagtactcgtaacggtacactcctactttgcacgaggttacggactcccaatccgaaggttcaggtgacaagtagntcgtaggaaactagttactttacccacacctagtcggtaggggttacctacgacgtccgtaaggtaacgttagttttcgaccgttaacttacttagtttacggtaactaaacgtacggttaccgtttaaccccgttcccggtacccccgggtacgttaccgggtaacccggaaacgggtaacccgaaagggttaacggtaaacgtaacgtaaacgggttccggtaaacgttggttacggcgttacgccgaacctaacttcgttccttactccttacttcccgtttccccgtaacc

SEQ ID NO: 437344 - DNA, 685 bp, Homo sapiens
  misc_feature: GZ8MTXP01EWFYE.13.38.D05.1.454.CMB.2.raw
  modified_base (242)..(242): a, c, t, g, unknown or other
  modified_base (327)..(327): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggagggccaccatcaactgacaagtccagccagagttgttttanacagcctaccaacaataagtaacttcttagcttaggtaccagacaagaaaccaggacagccctactaagctgctactatttacgngggactatcgtacgtaccggggaacgttccccgggggtccccctggtaaccgtatttccgaaggttcgggaccgtaacgggtccggggttaccgtacgggggaacctaaggttactttttaccaaccctttccttaccaaccctaactaccgaacggccaacggtccccttaggaccgagggtaccttaagggaaacgtaggttgggggtacgggttacttaaggttttacttaaccgtgtacgtagtaactaaattattaagttcgtaccttccgtcgacggtccttacgtacgtttcgggacgggttacgggaccgtaagggtcgaagtacgtacgaaaacggtcgttgggtaacg

SEQ ID NO: 437345 - DNA, 606 bp, Homo sapiens
  misc_feature: GZ8MTXP01EXF0L.13.38.D05.1.454.CMB.2.raw
  modified_base (239)..(239): a, c, t, g, unknown or other
  modified_base (528)..(528): a, c, t, g, unknown or other
  modified_base (589)..(589): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtggcgagagggccacatcaactgcaagtccagccagtagttgttttanacagctaccaaacaataagaacttctagcttaggtaccagacaacgaaaccaggacacgccctactaagctcgctactatttacgtgggctatcttacggtccggggaaacgtccccgggggttacccccctaggtaaccgtatttcccgaagggttgggaccgtaaggggtccgggtaccggtacgggggaacctaggttactttacacccttctaccaccgtatcgagcaacggtctacgacacggactaggaaatagtgggtaggtacttaggtttattactgtanatataataatatactactctcgcgtcttacgtacgtcggacggacggacgaaggagaaganacgaacgtaacgttgtg

SEQ ID NO: 437346 - DNA, 713 bp, Homo sapiens
  misc_feature: GZ8MTXP01CUU16.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccacctgtctgcgtctctcggagacagggtcaccatcacgttggtcgggacaaggtcaagaactagttgggactaacttactttaaattggtatcagacagaagtcaggcaacgccccgaacctcctgactctacgtacactccactttgacacgagtcggactcccaatccgtaacggttacaggtcggactaaagtagaagttcgtaaggaaacctacggttaaccttttacccctacgtaaccctacgtacgtaacggggtacctaccgtacggtacccgtaaggtaaacgttagttttacgacgttaactttacgttaagttacgtacctaaacgtaggttaaccgtttaaccccgttcccgttacccccgggtacgtttacccggaaccggtaaacggggtaaccctaaaggggtttacggaaaacgttaacggaaaacggccggtaaaacgttcggtaaacggtccgttacggccttaacccgtaacttaccgttcggttacctttccttaactttcccttccgtttaacccg

SEQ ID NO: 437347 - DNA, 610 bp, Homo sapiens
  misc_feature: GZ8MTXP01B2N5R.13.38.D05.1.454.CMB.2.raw
  modified_base (268)..(268): a, c, t, g, unknown or other
  modified_base (281)..(281): a, c, t, g, unknown or other
  modified_base (337)..(337): a, c, t, g, unknown or other
  modified_base (535)..(535): a, c, t, g, unknown or other
  modified_base (547)..(547): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggaggtcggtggggggggcttgggttaagccgtggggggtccctcagactctcctgtgcacctntgattctatttcnctgacgtctggttgagtcgtgggtcccgcgaggccgtcccggggaagggcgtgggnggttggggtggacgttaagttaaaggtagaagacagtggacggacaacgacgactacgaggtcgttcccgaagaaggcagtactcactatctacaagagtatagaactacgaaaaagtaatagaaattatatctagaacaaatacgaaacaacgtaagaaacgacgagaacacgagtcgtagtattactcgaccaagngagtcggacagnttcggacgttaacggtcggaccgaacggacgtacggttaccgaacgttaacgggtcccggggg

SEQ ID NO: 437348 - DNA, 567 bp, Homo sapiens
  misc_feature: GZ8MTXP01EWUIF.13.38.D05.1.454.CMB.2.raw
  modified_base (242)..(242): a, c, t, g, unknown or other
  modified_base (254)..(254): a, c, t, g, unknown or other
  modified_base (265)..(265): a, c, t, g, unknown or other
  modified_base (319)..(319): a, c, t, g, unknown or other
  modified_base (371)..(371): a, c, t, g, unknown or other
  modified_base (380)..(380): a, c, t, g, unknown or other
  modified_base (425)..(425): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccacggggacatcgtgatgacccagtctccagactccctggctgtgtctcgtgggcgaggagggccaccatcaactgcaagtccagccagtagttgtttanacagctaccaanaataagacttntagcttgaccagcaagaaacaggacagccctactaagctagctactatttacgnggcatctacgtccgggaacgtccgggtccccctagacgattcgaggtcgcgnggcgggtcngggactagtcttcactctcacatcagcacgctgcgagctagaagngtgggtcgtactagtttatacgtgtacagtactaattagttaactacgttaccgtccgtaccggttaggtccttacgtacgtttacgggcgggttaggacccgtaagggtagaagtacgtacgaaacgtaacgttgtaacgg

SEQ ID NO: 437349 - DNA, 607 bp, Homo sapiens
  misc_feature: GZ8MTXP01C03C6.13.38.D05.1.454.CMB.2.raw
  modified_base (243)..(243): a, c, t, g, unknown or other
  modified_base (256)..(256): a, c, t, g, unknown or other
  modified_base (272)..(272): a, c, t, g, unknown or other
  modified_base (311)..(311): a, c, t, g, unknown or other
  modified_base (388)..(388): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggccaccatcaactgacaagtccagccagtagttgtttanacagctaccaaanaataagtaacttctancttaggaccagacaagaaaccaggacacgccctactaanctagctactattacgtgggctatctacgtccggggaactcccggggtcccctaggaccgtattccgaggtcgggcgngggtccgggtacgtagggactagtactttcactctacaccgatcagtacacgcccgtgacgtaggctaggaagtgtgggtacgtacgttagtttactacgtgacagtaactaatttaatacgtacgtaccgtaaccgtcgttaggtccttacgtaccggttcgggacggttacggaaccgtaagggtacgaacgtacaacgaacgtaacgttggtaacg

SEQ ID NO: 437350 - DNA, 585 bp, Homo sapiens
  misc_feature: GZ8MTXP01BRZT1.13.38.D05.1.454.CMB.2.raw
  modified_base (255)..(255): a, c, t, g, unknown or other
  modified_base (327)..(327): a, c, t, g, unknown or other
  modified_base (385)..(385): a, c, t, g, unknown or other
  modified_base (545)..(545): a, c, t, g, unknown or other
  modified_base (578)..(578): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagactccctggctgtgtctcgtgggcgaggagggccaccatcaactgcaagtccagccagtagttgtttatacagcctaccaanaaataagtaacttctagcttaggtaccagacaagaaaccaggacagcctacctaagctgctactagtttacngggctatctagtaccgggaagttccccgggggtcccctaggacgattcacggtggcgnggtcgggtcgtgggacagtactttcactctacacctatcagcgaacgccgtgcgaggcgtaggaagtagtggggtagggtcttaaggtttacttactcgtacgagtactaagtattagtactacgccgtcgacggtacttcgtaccggttgggaccgggnggaccgaagggtgaagactacgaaacgtaacgngtaacgg

SEQ ID NO: 437351 - DNA, 653 bp, Homo sapiens
  misc_feature: GZ8MTXP01BXH35.13.38.D05.1.454.CMB.2.raw
  modified_base (194)..(194): a, c, t, g, unknown or other
  modified_base (290)..(291): a, c, t, g, unknown or other
  modified_base (295)..(295): a, c, t, g, unknown or other
  modified_base (298)..(298): a, c, t, g, unknown or other
  modified_base (301)..(301): a, c, t, g, unknown or other
  modified_base (308)..(308): a, c, t, g, unknown or other
  modified_base (317)..(317): a, c, t, g, unknown or other
  modified_base (333)..(333): a, c, t, g, unknown or other
  modified_base (339)..(339): a, c, t, g, unknown or other
tcagtcacgtactacacgaccggtgctcgatttagtatctgatagttgggtttggggagagaagacaggattcaggacaatctccagcatggccggcttccctctcctcctcaccctcctcactcactgtgcagggtcctgggcccagtctgtgctgactcagccaccctcaggcgtctcggggacccccgggnaggagggtcaccatctcttgttctggaagcagcctacaaacatcggaaatattatgttatattggtatcagctagctccaggaacggcccccaaannctanatntanagaatancacgcgccncgacggtcctgacgtntctcgngactaccagtcgcgccacctacacgtcccgtccgtcgcctacgtcggtacgggtcgggtacccgtccgggtacgaggtacgtggacggtcgtacgtacgttacgttacgtacgtcgacgacgtacgacggggtacggtacgtacgtacgacggcggtacggtacgggttacgggttccgggttcgggttcggggtacggggacggggtaaccggtaacggttacggtacggttaccggtaccggttacggttacgaccgaccggtaaccggtccgtcccgtccccgtccggttaccgtaaccgttccgttcccg
